US009816128B2

(12) United States Patent
Brandon et al.

(10) Patent No.: US 9,816,128 B2
(45) Date of Patent: Nov. 14, 2017

(54) POLYNUCLEOTIDE MARKER GENES AND THEIR EXPRESSION, FOR DIAGNOSIS OF ENDOTOXEMIA

(71) Applicant: Athlomics Pty Ltd, Queensland (AU)

(72) Inventors: Richard Bruce Brandon, Kenmore (AU); Mervyn Rees Thomas, Chapel Hill (AU)

(73) Assignee: IMMUNEXPRESS PTY LTD, Toowong (AU)

(*) Notice: Subject to any disclaimer, the term of this patent is extended or adjusted under 35 U.S.C. 154(b) by 482 days.

(21) Appl. No.: 13/754,634

(22) Filed: Jan. 30, 2013

(65) Prior Publication Data
US 2013/0210658 A1  Aug. 15, 2013

Related U.S. Application Data

(63) Continuation of application No. 11/994,996, filed as application No. PCT/AU2006/000970 on Jul. 7, 2006.

(60) Provisional application No. 60/696,776, filed on Jul. 7, 2005.

(51) Int. Cl.
*C12Q 1/68* (2006.01)
*G01N 33/569* (2006.01)
(52) U.S. Cl.
CPC ........ *C12Q 1/6809* (2013.01); *C12Q 1/6883* (2013.01); *G01N 33/56911* (2013.01); *C12Q 2600/158* (2013.01); *G01N 2800/26* (2013.01)
(58) Field of Classification Search
None
See application file for complete search history.

(56) References Cited

U.S. PATENT DOCUMENTS

| 2002/0187480 A1 | 12/2002 | Brandon |
| 2003/0194752 A1 | 10/2003 | Anderson et al. |
| 2004/0001803 A1* | 1/2004 | Hancock et al. ............ 424/85.2 |
| 2005/0130185 A1 | 6/2005 | Lu et al. |
| 2009/0264305 A1 | 10/2009 | Brandon et al. |

FOREIGN PATENT DOCUMENTS

| DE | 10315031 A1 | 10/2004 |
| DE | 102004015605 A1 | 10/2005 |
| EP | 1 270 740 A1 | 1/2003 |
| WO | WO 02/090579 A1 | 11/2002 |
| WO | WO 03/052049 A2 | 6/2003 |
| WO | WO 2004/043236 A2 | 5/2004 |
| WO | WO 2004/044556 A2 | 5/2004 |

OTHER PUBLICATIONS

Fukuda et al., "Cloning of cDNAs Encoding Human Lysosomal Membrane Glycoproteins, h-lamp-1 and h-lamp-2," J. Biol. Chem. 1988, 263:18920-18928.*
Bermingham et al., "The Mouse lysosomal membrane protein 1 Gene as a Candidate for the motorneuron degeneration (mnd) Locus," Genomics 1996, 32:266-271.*
Abdellah et al., "Finishing the euchromatic sequence of the human genome", Nature, 431:931-945 (2004).
Andreassen, S. et al., "Lysosomal enzyme pattern in lung lymph and blood during E. coil sepsis in sheep", Scand. J. Clin. Lab. Invest., 47:355-362 (1987).
Anel, R. et al., "Human endotoxemia and human sepsis: limits to the model", Critical Care, 9(2):151-152 (2005).
Bone, R.C., "Sir Isaac Newton, sepsis, SIRS, and CARS", Critical Care Medicine, 24(4):1125-1128, 6 pages (1996).
Buras, J.A. et al., "Animal models of sepsis: setting the stage", Nature Reviews: Drug Discovery, 4:854-865 (2005).
Casey, L.C. et al., "Plasma Cytokine and Endotoxin Levels Correlate with Survival in Patients with the Sepsis Syndrome", Ann. Intern. Med., 119(8):771-778 (1993).
Chen, L. et al., "Hepatic Gene Expression Discriminates Responders and Nonresponders in Treatment of Chronic Hepatitis C Viral Infection", Gastroenterology, 128:1437-1444 (2005).
Chinnaiyan, A.M. et al., "Molecular Signatures of Sepsis Multiorgan Gene Expression Profiles of Systemic Inflammation", American Journal of Pathology, 159(4):1199-1209 (2001).
Clark, E.S. et al., "The effects of slow infusion of a low dosage of endotoxin in healthy horses", Equine Vet. J., Suppl 7:33-37 (1989).
Cobb, J.P. et al., "Application of genome-wide expression analysis to human health and disease", PNAS, 102(13):4801-4806 (2005).
Cohen, J., "The detection and interpretation of endotoxaemia", Intensive Care Med., 26:S51-S56 (2000).
Eaton, S.A. et al., "Digital Starling forces and hemodynamics during early laminitis induced by an aqueous extract of black walnut (Juglans nigra) in horses", American Journal of Veterinary Research, 56(10):1338-1344 (1995).
Elin, R.J. et al., "Lack of Clinical Usefulness of the Limulus Test in the Diagnosis of Endotoxemia", The New England Journal of Medicine, 293(11):521-524 (1975).
Garner, H.E. et al., "Equine Laminitis of Alimentary Origin: An Experimental Model", American Journal of Veterinary Research, 36(4):441-444 (1975).
Gibot, S. et al., "Soluble form of the Triggering Receptor Expressed on Myeloid Cells-1 as a Marker of Microbial Infection", Clinical Medicine and Research, 2(3):181-187 (2004).
Haeffner-Cavaillon, N. et al., "Molecular aspects of endotoxins relevant to their biological functions", Nephrol. Dial. Transplant, 14:853-860 (1998).
Hawes, A.S. et al., "Comparison of Peripheral Blood Leukocyte Kinetics After Live Escherichia coli, Endotoxin, or Interleukin-1α Administration: Studies Using a Novel Interleukin-1 Receptor Antagonist", Annals of Surgery, 218(1):79-90 (1993).

(Continued)

Primary Examiner — Kaijiang Zhang

(57) ABSTRACT

The invention discloses isolated endotoxemia marker polynucleotides selected from any one of 163 different polynucleotide sequences, or variants thereof. Endotoxemia related conditions are diagnosed in a test subject by aberrant expression of at least one of the endotoxemia markers or variants thereof. Of practical use, is the early diagnosis of disease, determining those animals at risk of developing endotoxemia, monitoring of an animals immune response to the disease and the enablement of better treatments. Of particular interest is the diagnosis of laminitis in hoofed animals, including horses.

4 Claims, 2 Drawing Sheets

(56) References Cited

OTHER PUBLICATIONS

Hayashida, K. et al., "Pretreatment Prediction of Interferon-Alta Efficacy in Chronic Hepatitis C Patients", *Clinical Gastroenterology and Hepatology*, 3:1253-1259 (2005).

Holm, S., "A Simple Sequentially Rejective Multiple Test Procedure", *Scandinavian Journal of Statistics*, 6(2):65-70 (1979).

Hurley. J.C., "Endotoxemia: Methods of Detection and Clinical Correlates", *Clin. Microbiol. Reviews*, 8(2):268-292 (1995).

Johnson, P.J. et al., "Activation of extracellular matrix metalloproteinases in equine laminitis", *Veterinary Record, British Veterinary Association*, 142(15):392-396 (1998).

Juffermans, N.P. et al., "Expression of Human Immunodeficiency Virus Coreceptors CXC Chemokine Receptor 4 and CC Chemokine Receptor 5 on Monocytes is Down-regulated during Human Endotoxemia", *The Journal of Infectious Diseases*, 185(1):986-989 (2002).

Kirschner, K.F. et al., "Differential expression of cytokines and tumor necrosis factor receptor (TNFR) in plasma of nonhuman primates subjected to sublethal endotoxic shock", *Experimental Hematology*, 20(6):776, Abstract # 274 (1992).

Küster, H. et al., "Interleukin-1 receptor antagonist and interleukin-6 for early diagnosis of neonatal sepsis 2 days before clinical manifestation", *The Lancet*, 352(9136):1271-1277 (1998).

Lalu, M.M. et al., "Matrix metalloproteinase activities are altered in the heart and plasma during endotoxemia", *Critical Care Medicine*, 32(6):1332-1337 (2004).

Lau, Daryl T.-Y. et al., "Viral Hepatitis: Intrahepatic Gene Expression Profiles and Alpha-Smooth Muscle Actin Patterns in Hepatitis C Virus Induced Fibrosis", *Hepatology*, 42(2):273-281 (2005).

Layseca-Espinosa, E. et al., "Expression of CD64 as a potential marker of neonatal sepsis", *Pediatric Allergy and Immunology*, 13(5):319-327 (2002).

Lipcsey, M. et al., "Oxidative stress in animal models with special reference to experimental porcine endotoxemia", *Studies on Experimental Models, Oxidative stress in Applied Basic Research and Clinical Practice*, pp. 497-510 (2011).

Liu, Minghsun et al., "Early days: genomics and human responses to infection", *Current Opinion in Microbiology*, 9:312-319 (2006).

Marshall, J.C., et al. "Measures, markers, and mediators: Toward a staging system for clinical sepsis", *Critical Medicine*, 31(5):1560-1567 (2003).

Marsik, C. et al., "Endotoxaemia modulates Toll-like receptors on leucocytes in humans", *British Journal of Haematology*, 121(4):653-656 (2003).

Martinez-G, L.A. et al., "Clinical Experience on the Detection of Endotoxemia with the Limulus Test", *The Journal of Infectious Diseases*, 127(1):102-105 (1973).

Merritt, "Where does the subject of black walnut extract-induced laminitis fit into a colic symposium?", *Equine Veterinary Journal*, 37(4): 289-291 (2005).

Mesko, B. et al., "Gene expression profiles in peripheral blood for the diagnosis of autoimmune diseases", Trends in Molecular Medicine, 17(4):223-233 (2011).

Monneret, G., et al., "The anti-inflammatory response dominates after septic shock association of low monocyte HLA-DR expression and high interleukin-10 concentration", *Immunology Letters*, 95:193-198 (2004).

Moore, J.N., "A Perspective on Endotoxemia", *American Association of Equine Practitioners Proceedings*, 47:61-74 (2001).

Morris, D.D., "Endotoxemia in Horses: A Review of Cellular and Humoral Mediators Involved in its Pathogenesis", *Journal of Veterinary Internal Medicine*, 5:167-181 (1991).

Mungall, B.A. et al., "In vitro evidence for a bacterial pathogenesis of equine laminitis", *Veterinary Microbiology*, 79(3):209-223 (2001).

Mungall and Pollitt et al., "Zymographic analysis of equine laminitis", *Histochem. Cell. Biol.*, 112(6):467-472 (1999).

Mungall and Pollitt et al., "Thermolysin Activates Equine Lamellar Hoof Matrix Metalloproteinases", *J. Comp. Path.*, 126(1):9-16 (2002).

Ng, P. C., et al., "Neutrophil CD64 is a Sensitive Diagnostic Marker for Early-Onset infection", *Pediatric Research*, 56(5):796-803 (2004).

Nichols, B.L. et al., GENBANK accession No. AF016833.2, accessed from http://www.ncbi.nlm.nih.gov/nucleotide/17648143?report=genbank&log$=nucltop&blast_rank=1&RID=ZD7CADM5016 on Jun. 13, 2011, 3 pages (1998).

Oikawa and Yamaoka, "Clinical, Hematological, and Biochemical Analysis of Experimental Endotoxemia in Thoroughbred Horses", *J. Equine Sci.*, 14(1):5-12 (2003).

Opdenakker, G., "New insights in the regulation of leukocytosis and the role played by leukocytes in septic shock", *Verhandelingen-Koniklijke Academie Voor Geneeskunde Van Belgie*, 63(6):531-538 (2001).

Orsini, J. et al., "Laminitis in Horses: through the lens of systems theory", *Journal of Equine Veterinary Science*, 29(2):105-114 (2009).

Pagenstecher, A. et al., "Regulation of Matrix Metalloproteinases and Their Inhibitor Genes in Lipopolysaccharide-Induced Endotoxemia in Mice", *American Journal of Pathology*, 157(1):197-210 (2000).

Panacek, E.A. et al., "Efficacy and safety of the monoclonal anti-tumor necrosis factor antibody $F(ab')_2$ fragment afelimomab in patients with severe sepsis and elevated interleukin-6 levels", *Crit. Care Med.*, 32(11):2173-2182 (2004).

Prabhakar, U. et al., "Correlation of Protein and Gene Expression Profiles of Inflammatory Proteins After Endotoxin Challenge in Human Subjects", *DNA and Cell Biology*, 24(7):410-431 (2005).

Prucha, M., et al., "Expression Profiling: Toward an Application in Sepsis Diagnostics", *Shock*, 22(1):29-33 (2004).

Raudsepp, T. et al., "Exceptional conservation of horse-human gene order on X chromosome revealed by high-resolution radiation hybrid mapping", *PNAS*, 101(8):2386-2391 (2004).

Rodgerson, D.H. et al., "Investigation of mRNA expression of tumor necrosis factor-α, interleukin-1β, and cyclooxygenase-2 in cultured equine digital artery smooth muscle cells after exposure to endotoxin", *American Journal of Veterinary Research*, 62(12):1957-1963 (2001).

Simon, R., "Diagnostic and prognostic prediction using gene expression profiles in high-dimensional microarray data", *British Journal of Cancer*, 89:1599-1604 (2003).

Shao, Run-Xuan et al., "Hepatic gene expression profiles associated with fibrosis progression and hepatocarinogenesis in Hepatitis C patients", *World J. of Gastroenterology*, 11(13):1995-1999 (2005).

Smith, M.W. et al., "Microarrays and other new technologies: Gene Expression Patterns That Correlate With Hepatitis C and Early Progression to Fibrosis in Liver Transplant Recipients", *Gastroenterology*, 130:179-187.

Spek, C.A. et al., "Treatment with an anti-CD14 monoclonal antibody delays and inhibits lipopolysaccharide-induced gene expression in humans in vivo", *Journal of Clinical Immunology*, 23(2):132-140 (2003).

Sprouse, R.F. et al., "Plasma endotoxin levels in horses subjected to carbohydrate induced laminitis", *Equine Veterinary Journal*, 19(1):25-28 (1987).

Stumacher, R.J. et al., "Limitations of the Usefulness of the Limulus Assay for Endotoxin", *The New England Journal of Medicine*, 288(24)1261-1264 (1973).

Suzuki, T. et al., "Comprehensive gene expression profile of LPS-stimulated human monocytes by SAGE", *Blood, American Society of Hematology*, 96(7): 2584-2591 (2000).

Thomas, T.J. et al., "Comparative analyses of multi-species sequences from targeted genomic regions", *Nature*, 424:788-793 (2003).

Turunen, R., et al., "Increased CD1 1b-Density on Circulating Phagocytes as an Early Sign of Late-Onset Sepsis in Extremely Low-Birth-Weight Infants", *Pediatric Research*, 57(2):270-275 (2005).

Ulloa, L. et al., "The cytokine profile: a code for Sepsis", *Trends in Molecular Medicine*, 11(2):56-63 (2005).

Van Eijk, Lucas TGJ et al., "Microvascular permeability during experimental human endotoxemia: an open intervention study", *Critical Care*, 9(2):R157-R164 (2005).

(56) References Cited

OTHER PUBLICATIONS

Van Eps, A.W. et al., "Equine laminitis model: cryotherapy reduces the severity of lesions evaluated seven days after induction with oligofructose", *Equine Veterinary Journal*, 41:1-6 (2009).

Van Eps, A.W. et al., "Equine laminitis: cryotherapy reduces the severity of the acute lesion", *Equine Veterinary Journal*, 36:255-260 (2004).

Van Deventer, Sander J.H. et al., "Experimental endotoxemia in humans: analysis of cytokine release and coagulation, fibrinolytic, and complement pathways", *Blood Journal*, 76:2520-2526 (1990).

Waguespack, R.W. et al., "Expression of the cyclooxygenase isoforms in the prodromal stage of black walnut-induced laminitis in horses", *American Journal of Veterinary Research*, 65(12):1724-1729 (2004).

Waguespack, R.W. et al., "Increased expression of MAIL, a cytokine-associated nuclear protein, in the prodromal stage of black walnut-induced laminitis", *Equine Veterinary Journal*, 36(3):285-291 (2004).

Whitney, A.R., et al.; "Individuality and variation in gene expression patterns in human blood", *PNAS*, 100(4); pp. 1896-1901 (2003).

\* cited by examiner

0 Hours versus 24 Hours

0 Hours versus 72 Hours

POLYNUCLEOTIDE MARKER GENES AND THEIR EXPRESSION, FOR DIAGNOSIS OF ENDOTOXEMIA

This application is a continuation of U.S. patent application Ser. No. 11/994,996, filed Jun. 9, 2008, which is a 35 U.S.C. 371 application of International Application No. PCT/AU06/00970 filed Jul. 7, 2006, which claims the benefit of U.S. Provisional Application No. 60/696,776 filed Jul. 7, 2005, all of which are entitled POLYNUCLEOTIDE MARKER GENES AND THEIR EXPRESSION, FOR DIAGNOSIS OF ENDOTOXEMIA, and each of which applications is herein incorporated by reference in its entirety. This application also contains a sequence listing submitted electronically via EFS-web, which serves as both the paper copy and the computer readable form (CRF) and consists of a file entitled "00704_8023_US01_Seq_Listing_AS_FILED_04_25_2013" which was created on Apr. 24, 2013, which is 1,972,249 bytes in size, and which is also herein incorporated by reference in its entirety.

FIELD OF THE INVENTION

This invention relates generally to a method and apparatus for the diagnosis, detection of host response, monitoring, treatment and management of endotoxemia and endotoxemia-induced conditions in mammals. The invention also relates to the use of this method in monitoring, treatment and management of conditions that can lead to endotoxemia. The invention has practical use in early diagnosis, diagnosis of mild or sub-clinical endotoxemia, in the detection of specific cell immune responses as part of active or progressive disease, in monitoring clinically affected animals, and in enabling better treatment and management decisions to be made in clinically and sub-clinically affected animals. Additionally, the invention has practical use in monitoring patients in critical care or intensive care units for endotoxemia and in predicting clinical outcome.

BACKGROUND OF THE INVENTION

Endotoxemia (also called septic shock and septic syndrome) is generally considered to result from an inability of the host defense mechanisms to cope with foreign organisms, including gram positive and negative bacteria, viruses, fungi and parasites. The majority of endotoxemia cases are caused by gram negative bacteria (Glauser et al., 1991, *Lancet* 338 (September) 732-736), in particular a product of gram negative bacteria called endotoxin or lipopolysaccharide (LPS), which is a component of the bacterial outer cell wall.

Because the main initiator of endotoxemia is endotoxin, many tests have been developed to measure these molecules in fluids, including the *Limulus* Amoebocyte Lysate (LAL) test (Cohen J., 2000, *Intensive Care Med.* 26: S51-S56), rabbit pyrogen test, and lethality in mice and chicken embryos (Hurley J C. *Clin Microbiol Reviews* 8(2): 268-292). However, measurement of endotoxin in fluids, especially blood, is a poor predictor of clinical outcome in endotoxemia for a number of reasons:

- The levels of endotoxin required to trigger the biological cascade of events leading to endotoxemia varies widely from patient to patient.
- The bioavailability of endotoxin varies from patient to patient depending upon the body's ability to detoxify or neutralize it.
- Some patients develop sensitivity to endotoxin, or are tolerant to endotoxin.
- Various biological fluids (and even fluid containers) contain agents that bind endotoxin that are capable of enhancing or limiting the biological effect of endotoxin, or can interfere with the measurement of endotoxin.
- Some endotoxins are more potent than others.
- The specificity and sensitivity of the LAL assay is at its limit when used for assaying endotoxin in blood or serum.

For these reasons, efforts have been made to develop assays for the determination of the biological effects of endotoxin—as a means of determining clinical outcome—including the measurement of molecules such as Tumor Necrosis Factor (TNF), C3a, C5a, Factor XII (Hageman Factor), interleukin-1 (IL-1), γ-interferon and various other cytokines, and the measurement of the level of activation of leukocytes. Such measurements have contributed to a "sepsis score" concept developed by Casey et al. (1993, *Ann Intern Med.* 119: 771-778).

However, none of these tests have been sufficiently sensitive, specific or practical enough to be used in routine clinical practice. In addition, the efficacy of available treatments also limits the practical use of such prognostic and monitoring tests.

Despite this, there are a number of features of endotoxemia that make early detection, monitoring, determination of clinical outcome, prognosis determination, early intervention and informed management of affected animals clinically and economically important, viz:

- Many and varied conditions can lead to endotoxemia.
- Endotoxemia can lead to many other conditions.
- Endotoxemia is often a peracute condition causing death if not correctly managed.
- It is estimated that 20-30% of human patients in intensive care units in the USA are affected and that more than 100,000 humans die each year in the USA alone (Young L & Glauser M (Eds) Gram negative septicemia and septic shock. WB Saunders Philadelphia (1991); Parrillo J E. 1990, *Ann Intern Med.* 113: 227-242).
- The extent of the condition in less developed countries is likely to be far higher due to poor hygiene and medical infrastructure.
- In up to 50% of cases an etiological agent is not determined.
- The condition is most common in hospitals in patients with other underlying diseases.
- The extent of subclinical disease and its effects on human health, animal husbandry, athletic performance, and ethical management are not known.

Apart from the direct detection of endotoxin, there have been many efforts to use secondary indicators of sepsis to diagnose and monitor this condition, including measuring heart rate, temperature, respiratory rate, cardiac output, systemic vascular resistance, plasma IL-6 levels, macrophage inflammatory protein-2, chemokine KC, protein C and C-reactive protein (Panacek et al., 2004, *Crit Care Med.* 32: 2173-2182; Ulloa and Tracey, 2005, *Trends Mol Med.* 1:56-63).

Currently no panel of biomarkers is used to define sepsis in humans (Buras et al., 2006, *Nature Reviews Drug Discovery*, 4: 854-865). However, a cytokine profile has been suggested (Ulloa et al., 2005, *Trends Mol Biol.* 11: 56-63) Reasons for this are the complexity of the disease, difficulty in defining the stage of disease and the apparent existence of two distinct but not mutually exclusive phases of inflammatory and anti-inflammatory responses (Bone R C., 1996, *Crit Care Med.* 24: 1125-1128).

Given the current limitations of diagnostic, monitoring and prognostic procedures for endotoxemia, especially in sub-clinical or early-stages, there is a need for more effective modalities for early detection, diagnosis, monitoring, prognosis and management of the various phases of sepsis including, acute, peracute, early stage, advanced, and sub-clinical endotoxemia.

An example of a complication arising from endotoxemia is laminitis that causes profound lameness in hoofed animals. It occurs in perissodactyl and artiodactyl animals, including horses, cattle, goats, sheep and other hoofed animals (ungulates). It is believed the condition results from the action of endotoxin on tissues and the lamellae of the inner hoof wall. Failure of the lamellae results in separation of the inner hoof capsule from the pedal bone and the subsequent (weight-bearing) driving of the pedal bone through the hoof capsule, and crushing of the corium, sole and coronet (Sloet van Oldruitenborgh-Oosterbaan M M., 1999, *Vet Quarterly* 21(4) 121-127).

There are a number of features of laminitis that make early detection, monitoring, early intervention and informed management of affected animals clinically and economically important, viz:

The exact cause of laminitis is not known.

The extent of subclinical disease (often called the developmental stage; Hood D M., 1999, *Vet Clin Nth Amer Eq Pract* 15(2): 287-294) and its effects on animal husbandry, athletic performance, and ethical management are not known.

The first 72 hours of the disease (developmental and acute stages) is the most critical period for monitoring. Animals that have not suffered major mechanical or structural failures at this stage are likely to recover.

The pathogenesis of the disease is poorly understood.

Laminitis is the largest killer of horses worldwide, usually as a result of euthanasia due to progressive disease that causes serious disability and pain.

Present diagnostics are only partially effective once the disease is established, by which time preventative management or ameliorating therapies have little effect.

There are few practical interventions available.

Thus, there is a need for more effective modalities for early diagnosis, diagnosis of mild or sub-clinical laminitis, in the detection of specific immune responses as part of active or progressive disease, and in monitoring animals clinically affected by laminitis. Such modalities would enable better treatment and management decisions to be made in clinically and sub-clinically affected animals prior to irreversible tissue damage.

Existing technology for diagnosing endotoxemia or for monitoring conditions that lead to endotoxemia or for evaluating sequelae of endotoxemia, is limited in that the detection of bacterial endotoxin in body fluids does not correlate well with clinical signs, and the sensitivity and specificity of these technologies is insufficient to be clinically useful. In addition, because the conditions are often peracute, advanced and irreversible tissue damage may have occurred (and possibly death) by the time endotoxin is able to be detected.

In addition, existing technologies for diagnosis or evaluation of laminitis are limited and are almost entirely reliant upon clinical evaluation and the detection of lameness. In many instances the lameness can be very subtle or sub-clinical. In addition, many of these clinical changes can only be observed in advanced stages of disease, at which time irreversible tissue damage has occurred, and where humane euthanasia is the only recourse.

SUMMARY OF THE INVENTION

The present invention represents a significant advance over current technologies for the management of affected animals. In certain advantageous embodiments, it relies upon measuring the level of certain markers in cells, especially circulating leukocytes, of the host rather than detecting endotoxin. As such, these methods are suitable for widespread screening of symptomatic and asymptomatic animals. In certain embodiments where circulating leukocytes are the subject of analysis, it is proposed that detection of a host response to endotoxemia and its sequelae (also referred to herein as "endotoxemia-related conditions") will be feasible at very early stages of its progression before extensive tissue damage has occurred.

Thus, the present invention addresses the problem of diagnosing endotoxemia-related conditions by detecting a host response that may be measured in host cells. Advantageous embodiments involve monitoring the expression of certain genes in peripheral leukocytes of the immune system, which may be reflected in changing patterns of RNA levels or protein production that correlate with the presence of active disease or response to disease.

Accordingly, in one aspect, the present invention provides methods for diagnosing the presence of an endotoxemia-related condition in a test subject, especially in an equine test subject. These methods generally comprise detecting in the test subject aberrant expression of at least one gene (also referred to herein as an "endotoxemia marker gene") selected from the group consisting of: (a) a gene having a polynucleotide expression product comprising a nucleotide sequence that shares at least 50% (and at least 51% to at least 99% and all integer percentages in between) sequence identity with the sequence set forth in any one of SEQ ID NO: 1, 3, 4, 5, 6, 7, 9, 10, 11, 13, 15, 16, 17, 18, 19, 21, 23, 25, 26, 27, 29, 31, 33, 35, 37, 38, 39, 41, 42, 43, 44, 45, 47, 49, 50, 52, 54, 56, 58, 60, 61, 63, 64, 66, 67, 68, 69, 70, 71, 73, 75, 76, 77, 78, 79, 80, 81, 82, 83, 84, 86, 88, 90, 92, 93, 94, 96, 98, 100, 101, 102, 103, 104, 106, 107, 109, 110, 111, 113, 114, 115, 117, 119, 121, 122, 123, 124, 125, 126, 128, 130, 132, 134, 136, 137, 139, 141, 143, 145, 147, 149, 151, 153, 155, 157, 158, 160, 162, 164, 166, 168, 169, 170, 172, 173, 174, 176, 178, 180, 182, 184, 186, 188, 190, 192, 193, 194, 195, 197, 199, 201, 203, 205, 206, 207, 209, 210, 211, 212, 214, 215, 216, 218, 220, 222, 223, 224, 225, 227, 229, 231, 233, 235, 236, 237, 239, 240, 242, 244, 245, 246, 248, 250, 252, 254, 255, 257, 259 260, 262, 264, 266, 268, 269, 270, 271, 272, 274, 276, 278, 279, 280, 282, 284, 286, 288, 290, 292, 294, 296, 298, 300, 302, 304, 305, 306, 307, 309, 311, 312, 314, 315, 316, 318, 320 321, 323 or 325, or a complement thereof; (b) a gene having a polynucleotide expression product comprising a nucleotide sequence that encodes a polypeptide comprising the amino acid sequence set forth in any one of SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326; (c) a gene having a polynucleotide expression product comprising a nucleotide sequence that encodes a polypeptide that shares at least 50% (and at least 51% to at least 99% and all integer percentages in between) sequence similarity with at least a portion of the sequence set forth in SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326, wherein the portion comprises at least 15 contiguous amino acid residues of that sequence; and (d) a gene having a polynucleotide expression product comprising a nucleotide sequence that hybridizes to the sequence of (a), (b), (c) or a complement thereof, under at least low, medium, or high stringency conditions. In accordance with the present invention, these endotoxemia marker genes are aberrantly expressed in animals with an endotoxemia-related condition such as but not limited to an endotoxemia-induced condition, illustrative examples of which include shock, depression, abdominal discomfort, reduced pain threshold, laminitis and idiopathic conditions.

As used herein, polynucleotide expression products of endotoxemia marker genes are referred to herein as "endotoxemia marker polynucleotides." Polypeptide expression products of the endotoxemia marker genes are referred to herein as "endotoxemia marker polypeptides."

Thus, in some embodiments, the methods comprise detecting aberrant expression of an endotoxemia marker polynucleotide selected from the group consisting of (a) a polynucleotide comprising a nucleotide sequence that shares at least 50% (and at least 51% to at least 99% and all integer percentages in between) sequence identity with the sequence set forth in any one of SEQ ID NO: 1, 3, 4, 5, 6, 7, 9, 10, 11, 13, 15, 16, 17, 18, 19, 21, 23, 25, 26, 27, 29, 31, 33, 35, 37, 38, 39, 41, 42, 43, 44, 45, 47, 49, 50, 52, 54, 56, 58, 60, 61, 63, 64, 66, 67, 68, 69, 70, 71, 73, 75, 76, 77, 78, 79, 80, 81, 82, 83, 84, 86, 88, 90, 92, 93, 94, 96, 98, 100, 101, 102, 103, 104, 106, 107, 109, 110, 111, 113, 114, 115, 117, 119, 121, 122, 123, 124, 125, 126, 128, 130, 132, 134, 136, 137, 139, 141, 143, 145, 147, 149, 151, 153, 155, 157, 158, 160, 162, 164, 166, 168, 169, 170, 172, 173, 174, 176, 178, 180, 182, 184, 186, 188, 190, 192, 193, 194, 195, 197, 199, 201, 203, 205, 206, 207, 209, 210, 211, 212, 214, 215, 216, 218, 220, 222, 223, 224, 225, 227, 229, 231, 233, 235, 236, 237, 239, 240, 242, 244, 245, 246, 248, 250, 252, 254, 255, 257, 259 260, 262, 264, 266, 268, 269, 270, 271, 272, 274, 276, 278, 279, 280, 282, 284, 286, 288, 290, 292, 294, 296, 298, 300, 302, 304, 305, 306, 307, 309, 311, 312, 314, 315, 316, 318, 320 321, 323 or 325, or a complement thereof; (b) a polynucleotide comprising a nucleotide sequence that encodes a polypeptide comprising the amino acid sequence set forth in any one of SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In other embodiments, the methods comprise detecting aberrant expression of an endotoxemia marker polypeptide selected from the group consisting of: (i) a polypeptide comprising an amino acid sequence that shares at least 50% (and at least 51% to at least 99% and all integer percentages in between) sequence similarity with the sequence set forth in any one of SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326; (ii) a polypeptide comprising a portion of the sequence set forth in any one of SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326, wherein the portion comprises at least 5 contiguous amino acid residues of that sequence; (iii) a polypeptide comprising an amino acid sequence that shares at least 30% similarity with at least 15 contiguous amino acid residues of the sequence set forth in any one of SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326; and (iv) a polypeptide comprising a portion of the sequence set forth in any one of SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326, wherein the portion comprises at least 5 contiguous amino acid residues of that sequence and is immuno-interactive with an antigen-binding molecule that is immuno-interactive with a sequence of (i), (ii) or (iii).

Typically, such aberrant expression is detected by: (1) measuring in a biological sample obtained from the test subject the level or functional activity of an expression product of at least one endotoxemia marker gene and (2) comparing the measured level or functional activity of each expression product to the level or functional activity of a corresponding expression product in a reference sample obtained from one or more normal subjects or from one or more subjects lacking disease, wherein a difference in the level or functional activity of the expression product in the biological sample as compared to the level or functional activity of the corresponding expression product in the reference sample is indicative of the presence of an endotoxemia-related condition in the test subject. In some embodiments, the methods further comprise diagnosing the presence, stage or degree of an endotoxemia-related condition in the test subject when the measured level or functional activity of the or each expression product is different than the measured level or functional activity of the or each corresponding expression product. In these embodiments, the difference typically represents an at least about 10%, 20%, 30%, 40%, 50%, 60%, 70%, 80% or 90%, or even an at least about 100%, 200%, 300%, 400%, 500%, 600%, 700%, 800%, 900% or 1000% increase, or an at least about 10%, 20%, 30% 40%, 50%, 60%, 70%, 80%, 90%, 92%, 94%, 96%, 97%, 98% or 99%, or even an at least about 99.5%, 99.9%, 99.95%, 99.99%, 99.995% or 99.999% decrease in the level or functional activity of an individual expression product as compared to the level or functional activity of an individual corresponding expression product, which is hereafter referred to as "aberrant expression." In illustrative examples of this type, the presence of an endotoxemia-related condition is determined by detecting a decrease in the level or functional activity of at least one endotoxemia marker polynucleotide selected from (a) a polynucleotide comprising a nucleotide sequence that shares at least 50% (and at least 51% to at least 99% and all integer percentages in between) sequence identity with the sequence set forth in any one of SEQ ID NO: 5, 6, 7, 11, 13, 15, 16, 17, 18, 19, 21, 25, 26, 35, 37, 38, 41, 42, 43, 44, 50, 52, 54, 58, 60, 63, 64, 69, 70, 71, 73, 77, 79, 80, 81, 82, 83, 86, 92, 93, 96, 98, 100, 101, 102, 103, 104, 106, 115, 117, 128, 134, 137, 141, 143, 153, 155, 158, 162, 164, 166, 174, 182, 186, 188, 190, 195, 197, 199, 201, 205, 206, 207, 209, 210, 211, 214, 215, 216, 222, 223, 240, 244, 246, 248, 259, 260, 269, 272, 280, 282, 284, 286, 290, 298, 300, 302, 305, 306, 307, 309, 312, 314, 315, 316, 318, 320, 321, 323, or a complement thereof; (b) a polynucleotide comprising a nucleotide sequence that encodes a polypeptide comprising the amino acid sequence set forth in any one of SEQ ID NO: 8, 12, 14, 20, 22, 36, 51, 53, 55, 59, 65, 72, 74, 78, 87, 97, 99, 105, 116, 118, 129, 135, 138, 142, 144, 154, 156, 159, 163, 165, 167, 175, 183, 187, 189, 191, 196, 198, 200, 202, 208, 217, 241, 247, 249, 261, 273, 281, 283, 285, 287, 291, 299, 301, 303, 308, 310, 313, 317, 319, 322, 324; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 8, 12, 14, 20, 22, 36, 51, 53, 55, 59, 65, 72, 74, 78, 87, 97, 99, 105, 116, 118, 129, 135, 138, 142, 144, 154, 156, 159, 163, 165, 167, 175, 183, 187, 189, 191, 196, 198, 200, 202, 208, 217, 241, 247, 249, 261, 273, 281, 283, 285, 287, 291, 299, 301, 303, 308, 310, 313, 317, 319, 322, 324, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In other illustrative examples, the presence of an endotoxemia-related condition is determined by detecting an increase in the level or functional activity of at least one endotoxemia marker polynucleotide selected from (a) a polynucleotide comprising a nucleotide sequence that shares at least 50% (and at least 51% to at least 99% and all integer percentages in between) sequence identity with the sequence set forth in any one of SEQ ID NO: 1, 3, 4, 9, 10, 23, 27, 29, 31, 33, 39, 45, 47, 49, 56, 61, 66, 67, 68, 75, 76, 84, 88, 90, 94, 107, 109, 110, 111, 113, 114, 119, 121, 122, 123, 124, 125, 126, 130, 132, 136, 139, 145, 147, 149, 151, 157, 160, 168, 169, 170, 172, 173, 176, 178, 180, 184, 192, 193, 194, 203, 212, 218, 220, 224, 225, 227, 229, 231, 233, 235, 236, 237, 239, 242, 245, 250, 252, 254, 255, 257, 262, 264, 266, 268, 270, 271, 274, 276, 278, 279, 288, 292, 294, 296, 304, 311, 325, or a complement thereof; (b) a polynucleotide comprising a nucleotide sequence that encodes a polypeptide comprising the amino acid sequence set forth in any one of SEQ ID NO: 2, 24, 28, 30, 32, 34, 40, 46, 48, 57, 62, 85, 89, 91, 95, 108, 112, 120, 127, 131, 133, 140, 146, 148, 150, 152, 161, 171, 177, 179, 181, 185, 204, 213, 219, 221, 226, 228, 230, 232, 234, 238, 243, 251, 253, 256, 258, 263, 265, 267, 275, 277, 289, 293, 295, 297, 326; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 8, 12, 14, 20, 22, 36, 51, 53, 55, 59, 65, 72, 74, 78, 87, 97, 99, 105, 116, 118, 129, 135, 138, 142, 144, 154, 156, 159, 163, 165, 167, 175, 183, 187, 189, 191, 196, 198, 200, 202, 208, 217, 241, 247, 249, 261, 273, 281, 283, 285, 287, 291, 299, 301, 303, 308, 310, 313, 317, 319, 322, 324 wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In some embodiments, the method further comprises diagnosing the absence of an endotoxemia-related condition when the measured level or functional activity of the or each expression product is the same as or similar to the measured level or functional activity of the or each corresponding expression product. In these embodiments, the measured level or functional activity of an individual expression product varies from the measured level or functional activity of an individual corresponding expression product by no more than about 20%, 18%, 16%, 14%, 12%, 10%, 9%, 8%, 7%, 6%, 5%, 4%, 3%, 2%, 1% or 0.1%, which is hereafter referred to as "normal expression.".

In some embodiments, the methods comprise measuring the level or functional activity of individual expression products of at least about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 endotoxemia marker polynucleotides. For example, the methods may comprise measuring the level or functional activity of an endotoxemia marker polynucleotide either alone or in combination with as much as 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2 or 1 other endotoxemia marker polynucleotide(s). In another example, the methods may comprise measuring the level or functional activity of an endotoxemia marker polypeptide either alone or in combination with as much as 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2 or 1 other endotoxemia marker polypeptides(s). In illustrative examples of this type, the methods comprise measuring the level or functional activity of individual expression products of at least 1, 2, 3, 4, 5 or 6 endotoxemia marker genes that have a very high correlation ($p<0.001$) with the presence or risk of an endotoxemia-related condition (hereafter referred to as "level one correlation endotoxemia marker genes"), representative examples of which include, but are not limited to, (a) a polynucleotide comprising a nucleotide sequence that shares at least 50% (and at least 51% to at least 99% and all integer percentages in between) sequence identity with the sequence set forth in any one of SEQ ID NO: 11, 23, 29, 35, 43, 44, 68, 81, 82, 84, 104, 105, 107, 119, 130, 136, 147, 155, 174, 192, 193, 245, 254, 255, 262, 264, 270, 271, 279, 296, 325, or a complement thereof; (b) a polynucleotide comprising a nucleotide sequence that encodes a polypeptide comprising the amino acid sequence set forth in any one of SEQ ID NO: 12, 24, 30, 36, 85, 108, 120, 131, 148, 156, 175, 256, 263, 265, 297, 326; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 12, 24, 30, 36, 85, 108, 120, 131, 148, 156, 175, 256, 263, 265, 297, 326, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In other illustrative examples, the methods comprise measuring the level or functional activity of individual expression products of at least 1, 2, 3, 4, 5, 6, 7 or 8 endotoxemia marker genes that have a high correlation ($p<0.005$) with the presence or risk of an endotoxemia-related condition (hereafter referred to as "level two correlation endotoxemia marker genes"), representative examples of which include, but are not limited to, (a) a polynucleotide comprising a nucleotide sequence that shares at least 50% (and at least 51% to at least 99% and all integer percentages in between) sequence identity with the sequence set forth in any one of SEQ ID NO: 1, 7, 9, 10, 17, 18, 21, 25, 26, 33, 54, 61, 64, 79, 80, 90, 94, 115, 117, 121, 122, 125, 126, 143, 160, 162, 164, 172, 173, 178, 184, 186, 194, 199, 205, 206, 225, 229, 242, 244, 252, 257, 259, 274, 276, 282, 284, 288, 294, 306, 316, 318, or a complement thereof; (b) a polynucleotide comprising a nucleotide sequence that encodes a polypeptide comprising the amino acid sequence set forth in any one of SEQ ID NO: 2, 8, 22, 34, 55, 62, 65, 91, 95, 116, 118, 127, 144, 161, 163, 165, 179, 185, 187, 200, 226, 230, 243, 253, 258, 275, 277, 283, 285, 289, 295, 317, 319; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 2, 8, 22, 34, 55, 62, 65, 91, 95, 116, 118, 127, 144, 161, 163, 165, 179, 185, 187, 200, 226, 230, 243, 253, 258, 275, 277, 283, 285, 289, 295, 317, 319, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In still other illustrative examples, the methods comprise measuring the level or functional activity of individual expression products of at least 1, 2, 3, 4, 5, 6, 7, 8, 9 or 10 endotoxemia marker genes that have a medium correlation ($p<0.05$) with the presence or risk of an endotoxemia-related condition (hereafter referred to as "level three correlation endotoxemia marker genes"), representative examples of which include, but are not limited to, (a) a polynucleotide comprising a nucleotide sequence that shares at least 50% (and at least 51% to at least 99% and all integer percentages in between) sequence identity with the sequence set forth in any one of SEQ ID NO: 3, 4, 5, 6, 13, 15, 16, 27, 31, 37, 38, 39, 41, 42, 45, 47, 49, 52, 56, 58, 63, 66, 67, 69, 70, 71, 77, 83, 86, 88, 96, 98, 100, 101, 106, 109, 110, 111, 113, 114, 128, 132, 134, 137, 139, 141, 145, 149, 151, 153, 157, 158, 166, 168, 169, 176, 180, 188, 190, 197, 203, 207, 209, 210, 211, 214, 215, 218, 220, 222, 223, 224, 231, 233, 236, 237, 239, 240, 241, 246, 250, 260, 266, 268, 269, 272, 278, 280, 286, 290, 292, 300, 304, 309, 312, 314, 315, 321, 323, or a complement thereof; (b) a polynucleotide comprising a nucleotide sequence that encodes a polypeptide comprising the amino acid sequence set forth in any one of SEQ ID NO: 14, 28, 32, 40, 46, 48, 53, 57, 59, 72, 78, 87, 89, 97, 99, 112, 129, 133, 135, 138, 140, 142, 146, 150, 152, 154, 159, 167, 177, 181, 189, 191, 198, 204, 208, 219, 221, 232, 234, 238, 247, 251, 261, 267, 273, 281, 287, 291, 293, 301, 310, 313, 322, 324; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 14, 28, 32, 40, 46, 48, 53, 57, 59, 72, 78, 87, 89, 97, 99, 112, 129, 133, 135, 138, 140, 142, 146, 150, 152, 154, 159, 167, 177, 181, 189, 191, 198, 204, 208, 219, 221, 232, 234, 238, 247, 251, 261, 267, 273, 281, 287, 291, 293, 301, 310, 313, 322, 324, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In still other illustrative examples, the methods comprise measuring the level or functional activity of individual expression products of at least 1, 2, 3, 4, 5, 6, 7, 8, 9 or 10 endotoxemia marker genes that have a moderate correlation (significant at 72 hours post-induction only and $p<0.05$) with the presence or risk of an endotoxemia-related condition (hereafter referred to as "level four correlation endotoxemia marker genes"), representative examples of which include, but are not limited to, (a) a polynucleotide comprising a nucleotide sequence that shares at least 50% (and at least 51% to at least 99% and all integer percentages in between) sequence identity with the sequence set forth in any one of SEQ ID NO: 19, 50, 60, 73, 75, 92, 93, 102, 103, 123, 124, 170, 182, 195, 201, 212, 216, 227, 235, 248, 298, 302, 305, 307, 311, 320, or a complement thereof; (b) a polynucleotide comprising a nucleotide sequence that encodes a polypeptide comprising the amino acid sequence set forth in any one of SEQ ID NO: 20, 51, 74, 76, 171, 183, 196, 202, 213, 217, 228, 249, 299, 303, 308; (c) a polynucleotide comprising a nucleotide sequence that encodes a polypeptide that shares at least 50% (and at least 51% to at least 99% and all integer percentages in between) sequence similarity with at least a portion of the sequence set forth in SEQ ID NO: 20, 51, 74, 76, 171, 183, 196, 202, 213, 217, 228, 249, 299, 303, 308, wherein the portion comprises at least 15 contiguous amino acid residues of that sequence; and (d) a polynucleotide comprising a nucleotide sequence that hybridizes to the sequence of (a), (b), (c) or a complement thereof, under at least low, medium, or high stringency conditions.

In some embodiments, the methods comprise measuring the level or functional activity of an expression product of at least 1 level one correlation endotoxemia marker gene. In other embodiments, the methods comprise measuring the level or functional activity of an expression product of at least 2 level one correlation endotoxemia marker genes. In still other embodiments, the methods comprise measuring the level or functional activity of an expression product of at least 1 level one correlation endotoxemia marker gene and the level or functional activity of an expression product of at least 1 level two endotoxemia marker gene. In still other embodiments, the methods comprise measuring the level or functional activity of an expression product of at least 2 level one correlation endotoxemia marker genes and the level or functional activity of an expression product of at least 1 level two correlation endotoxemia marker gene. In still other embodiments, the methods comprise measuring the level or functional activity of an expression product of at least 1 level one correlation endotoxemia marker gene and the level or functional activity of an expression product of at least 2 level two correlation endotoxemia marker genes.

In some embodiments, the methods comprise measuring the level or functional activity of an expression product of at least 1 level one correlation endotoxemia marker gene and the level or functional activity of an expression product of at least 1 level three correlation endotoxemia marker gene. In other embodiments, the methods comprise measuring the level or functional activity of an expression product of at least 2 level one correlation endotoxemia marker genes and the level or functional activity of an expression product of at least 1 level three correlation endotoxemia marker gene. In still other embodiments, the methods comprise measuring the level or functional activity of an expression product of at least 1 level one correlation endotoxemia marker gene and the level or functional activity of an expression product of at least 2 level three correlation endotoxemia marker genes. In still other embodiments, the methods comprise measuring the level or functional activity of an expression product of at least 1 level one correlation endotoxemia marker gene and the level or functional activity of an expression product of at least 3 level three correlation endotoxemia marker genes.

In some embodiments, the methods comprise measuring the level or functional activity of an expression product of at least 1 level one correlation endotoxemia marker gene and the level or functional activity of an expression product of at least 1 level four correlation endotoxemia marker gene. In other embodiments, the methods comprise measuring the level or functional activity of an expression product of at least 2 level one correlation endotoxemia marker genes and the level or functional activity of an expression product of at least 1 level four correlation endotoxemia marker gene. In still other embodiments, the methods comprise measuring the level or functional activity of an expression product of at least 1 level one correlation endotoxemia marker gene and the level or functional activity of an expression product of at least 2 level four correlation endotoxemia marker gene. In still other embodiments, the methods comprise measuring the level or functional activity of an expression product of at least 1 level one correlation endotoxemia marker gene and the level or functional activity of an expression product of at least 3 level four correlation endotoxemia marker genes. In still other embodiments, the methods comprise measuring the level or functional activity of an expression product of at least 1 level one correlation endotoxemia marker gene and the level or functional activity of an expression product of at least 4 level four correlation endotoxemia marker genes.

In some embodiments, the methods comprise measuring the level or functional activity of an expression product of at least 1 level two correlation endotoxemia marker gene. In other embodiments, the methods comprise measuring the level or functional activity of an expression product of at least 2 level two correlation endotoxemia marker genes. In still other embodiments, the methods comprise measuring the level or functional activity of an expression product of at least 1 level two correlation endotoxemia marker gene and the level or functional activity of an expression product of at least 1 level three correlation endotoxemia marker gene. In other embodiments, the methods comprise measuring the level or functional activity of an expression product of at least 2 level two correlation endotoxemia marker genes and the level or functional activity of an expression product of at least 1 level three correlation endotoxemia marker gene. In still other embodiments, the methods comprise measuring the level or functional activity of an expression product of at least 1 level two correlation endotoxemia marker gene and the level or functional activity of an expression product of at least 2 level three correlation endotoxemia marker genes. In still other embodiments, the methods comprise measuring the level or functional activity of an expression product of at least 1 level two correlation endotoxemia marker gene and the level or functional activity of an expression product of at least 3 level three correlation endotoxemia marker genes. In still other embodiments, the methods comprise measuring the level or functional activity of an expression product of at least 1 level two correlation endotoxemia marker gene and the level or functional activity of an expression product of at least 4 level three correlation endotoxemia marker genes.

In some embodiments, the methods comprise measuring the level or functional activity of an expression product of at least 1 level two correlation endotoxemia marker gene and the level or functional activity of an expression product of at least 1 level four correlation endotoxemia marker gene. In other embodiments, the methods comprise measuring the level or functional activity of an expression product of at least 2 level two correlation endotoxemia marker genes and the level or functional activity of an expression product of at least 1 level four correlation endotoxemia marker gene. In still other embodiments, the methods comprise measuring the level or functional activity of an expression product of at least 1 level two correlation endotoxemia marker gene and the level or functional activity of an expression product of at least 2 level four correlation endotoxemia marker genes. In still other embodiments, the methods comprise measuring the level or functional activity of an expression product of at least 1 level two correlation endotoxemia marker gene and the level or functional activity of an expression product of at least 3 level four correlation endotoxemia marker genes. In still other embodiments, the methods comprise measuring the level or functional activity of an expression product of at least 1 level two correlation endotoxemia marker gene and the level or functional activity of an expression product of at least 4 level four correlation endotoxemia marker genes. In still other embodiments, the methods comprise measuring the level or functional activity of an expression product of at least 1 level two correlation endotoxemia marker gene and the level or functional activity of an expression product of at least 5 level four correlation endotoxemia marker genes.

In some embodiments, the methods comprise measuring the level or functional activity of an expression product of at least 1 level two correlation endotoxemia marker gene. In other embodiments, the methods comprise measuring the level or functional activity of an expression product of at least 2 level two correlation endotoxemia marker gene. In still other embodiments, the methods comprise measuring the level or functional activity of an expression product of at least 1 level two correlation endotoxemia marker gene and the level or functional activity of an expression product of at least 1 level five correlation endotoxemia marker gene. In other embodiments, the methods comprise measuring the level or functional activity of an expression product of at least 2 level two correlation endotoxemia marker genes and the level or functional activity of an expression product of at least 1 level five correlation endotoxemia marker gene. In still other embodiments, the methods comprise measuring the level or functional activity of an expression product of at least 1 level two correlation endotoxemia marker gene and the level or functional activity of an expression product of at least 2 level five correlation endotoxemia marker genes. In still other embodiments, the methods comprise measuring the level or functional activity of an expression product of at least 1 level two correlation endotoxemia marker gene and the level or functional activity of an expression product of at least 3 level five correlation endotoxemia marker genes. In still other embodiments, the methods comprise measuring the level or functional activity of an expression product of at least 1 level two correlation endotoxemia marker gene and the level or functional activity of an expression product of at least 4 level five correlation endotoxemia marker genes. In still other embodiments, the methods comprise measuring the level or functional activity of an expression product of at least 1 level two correlation endotoxemia marker gene and the level or functional activity of an expression product of at least 5 level five correlation endotoxemia marker genes.

In some embodiments, the methods comprise measuring the level or functional activity of an expression product of at least 1 level three correlation endotoxemia marker gene. In other embodiments, the methods comprise measuring the level or functional activity of an expression product of at least 2 level three correlation endotoxemia marker genes. In still other embodiments, the methods comprise measuring the level or functional activity of an expression product of at least 1 level three correlation endotoxemia marker gene and the level or functional activity of an expression product of at least 1 level four correlation endotoxemia marker gene. In other embodiments, the methods comprise measuring the level or functional activity of an expression product of at least 2 level three correlation endotoxemia marker genes and the level or functional activity of an expression product of at least 1 level four correlation endotoxemia marker gene. In still other embodiments, the methods comprise measuring the level or functional activity of an expression product of at least 1 level three correlation endotoxemia marker gene and the level or functional activity of an expression product of at least 2 level four correlation endotoxemia marker genes. In still other embodiments, the methods comprise measuring the level or functional activity of an expression product of at least 1 level three correlation endotoxemia marker gene and the level or functional activity of an expression product of at least 3 level four correlation endotoxemia marker genes. In still other embodiments, the methods comprise measuring the level or functional activity of an expression product of at least 1 level three correlation endotoxemia marker gene and the level or functional activity of an expression product of at least 4 level four correlation endotoxemia marker genes. In still other embodiments, the methods comprise measuring the level or functional activity of an expression product of at least 1 level three correlation endotoxemia marker gene and the level or functional activity of an expression product of at least 5 level four correlation endotoxemia marker genes.

In some embodiments, the methods comprise measuring the level or functional activity of an expression product of at least 1 level four correlation endotoxemia marker gene. In other embodiments, the methods comprise measuring the level or functional activity of an expression product of at least 2 level four correlation endotoxemia marker genes. In other embodiments, the methods comprise measuring the level or functional activity of an expression product of at least 3 level four correlation endotoxemia marker genes. In still other embodiments, the methods comprise measuring the level or functional activity of an expression product of at least 3 level four correlation endotoxemia marker genes. In still other embodiments, the methods comprise measuring the level or functional activity of an expression product of at least 4 level four correlation endotoxemia marker genes. In still other embodiments, the methods comprise measuring the level or functional activity of an expression product of at least 5 level four correlation endotoxemia marker genes. In still other embodiments, the methods comprise measuring the level or functional activity of an expression product of at least 6 level four correlation endotoxemia marker genes.

Advantageously, the biological sample comprises blood, especially peripheral blood, which suitably includes leukocytes. Suitably, the expression product is selected from a RNA molecule or a polypeptide. In some embodiments, the expression product is the same as the corresponding expression product. In other embodiments, the expression product is a variant (e.g., an allelic variant) of the corresponding expression product.

In certain embodiments, the expression product or corresponding expression product is a target RNA (e.g., mRNA) or a DNA copy of the target RNA whose level is measured using at least one nucleic acid probe that hybridists under at least low, medium, or high stringency conditions to the target RNA or to the DNA copy, wherein the nucleic acid probe comprises at least 15 contiguous nucleotides of an endotoxemia marker polynucleotide. In these embodiments, the measured level or abundance of the target RNA or its DNA copy is normalized to the level or abundance of a reference RNA or a DNA copy of the reference RNA that is present in the same sample. Suitably, the nucleic acid probe is immobilized on a solid or semi-solid support. In illustrative examples of this type, the nucleic acid probe forms part of a spatial array of nucleic acid probes. In some embodiments, the level of nucleic acid probe that is bound to the target RNA or to the DNA copy is measured by hybridization (e.g., using a nucleic acid array). In other embodiments, the level of nucleic acid probe that is bound to the target RNA or to the DNA copy is measured by nucleic acid amplification (e.g., using a polymerase chain reaction (PCR)). In still other embodiments, the level of nucleic acid probe that is bound to the target RNA or to the DNA copy is measured by nuclease protection assay.

In other embodiments, the expression product or corresponding expression product is a target polypeptide whose level is measured using at least one antigen-binding molecule that is immuno-interactive with the target polypeptide. In these embodiments, the measured level of the target polypeptide is normalized to the level of a reference polypeptide that is present in the same sample. Suitably, the antigen-binding molecule is immobilized on a solid or semi-solid support. In illustrative examples of this type, the antigen-binding molecule forms part of a spatial array of antigen-binding molecule. In some embodiments, the level of antigen-binding molecule that is bound to the target polypeptide is measured by immunoassay (e.g., using an ELISA).

In still other embodiments, the expression product or corresponding expression product is a target polypeptide whose level is measured using at least one substrate for the target polypeptide with which it reacts to produce a reaction product. In these embodiments, the measured functional activity of the target polypeptide is normalized to the functional activity of a reference polypeptide that is present in the same sample.

In some embodiments, a system is used to perform the diagnostic methods as broadly described above, which suitably comprises at least one end station coupled to a base station. The base station is suitably caused (a) to receive subject data from the end station via a communications network, wherein the subject data represents parameter values corresponding to the measured or normalized level or functional activity of at least one expression product in the biological sample, and (b) to compare the subject data with predetermined data representing the measured or normalized level or functional activity of at least one corresponding expression product in the reference sample to thereby determine any difference in the level or functional activity of the expression product in the biological sample as compared to the level or functional activity of the corresponding expression product in the reference sample. Desirably, the base station is further caused to provide a diagnosis for the presence, absence or degree of endotoxemia-related conditions. In these embodiments, the base station may be further caused to transfer an indication of the diagnosis to the end station via the communications network.

In another aspect, the invention contemplates use of the methods broadly described above in the monitoring, treatment and management of conditions that can lead to endotoxemia, illustrative examples of which include retained placenta, meningitis, endometriosis, shock, toxic shock (i.e., a sequelae to tampon use), gastroenteritis, appendicitis, ulcerative colitis, Crohn's disease, inflammatory bowel disease, acid gut syndrome, liver failure and cirrhosis, failure of colostrum transfer in neonates, ischemia (in any organ), bacteraemia, infections within body cavities such as the peritoneal, pericardial, thecal, and pleural cavities, burns, severe wounds, excessive exercise or stress, hemodialysis, conditions involving intolerable pain (e.g., pancreatitis, kidney stones), surgical operations, and non-healing lesions. In these embodiments, the diagnostic methods of the invention are typically used at a frequency that is effective to monitor the early development of an endotoxemia-related condition to thereby enable early therapeutic intervention and treatment of that condition. In illustrative examples, the diagnostic methods are used at least at 1, 2, 3, 4, 5, 6, 7, 8, 9, 10, 11, 12, 13, 14, 15, 16, 17, 18, 19, 20, 21, 22, 23 or 24 hour intervals.

In yet another aspect, the present invention provides methods for treating, preventing or inhibiting the development of an endotoxemia-related condition in a subject. These methods generally comprise detecting aberrant expression of at least one endotoxemia marker gene in the subject, and administering to the subject an effective amount of an agent that treats or ameliorates the symptoms or reverses or inhibits the development of the endotoxemia-related condition in the subject. Representative examples of such treatments or agents include but are not limited to, antibiotics, steroids, intravenous fluids, vasoactives, pallia-tive support for damaged or distressed organs (e.g. oxygen for respiratory distress, fluids for hypovolemia) and close monitoring of vital organs.

In still another aspect, the present invention provides isolated polynucleotides, referred to herein as "endotoxemia marker polynucleotides," which are generally selected from: (a) a polynucleotide comprising a nucleotide sequence that shares at least 50% (and at least 51% to at least 99% and all integer percentages in between) sequence identity with the sequence set forth in any one of SEQ ID NO: 3, 4, 9, 15, 16, 17, 18, 25, 26, 37, 38, 41, 42, 43, 44, 49, 63, 66, 67, 68, 69, 70, 75, 76, 79, 80, 81, 82, 83, 92, 93, 100, 101, 102, 103, 106, 109, 110, 113, 114, 121, 122, 123, 124, 125, 136, 157, 168, 169, 172, 173, 192, 193, 194, 205, 206, 209, 210, 211, 214, 215, 222, 223, 224, 235, 236, 239, 244, 245, 254, 259, 268, 269, 270, 271, 278, 279, 304, 305, 306, 311, 314, 315 or 320, or a complement thereof; (b) a polynucleotide comprising a portion of the sequence set forth in any one of SEQ ID NO: 3, 4, 9, 15, 16, 17, 18, 25, 26, 37, 38, 41, 42, 43, 44, 49, 63, 66, 67, 68, 69, 70, 75, 76, 79, 80, 81, 82, 83, 92, 93, 100, 101, 102, 103, 106, 109, 110, 113, 114, 121, 122, 123, 124, 125, 136, 157, 168, 169, 172, 173, 192, 193, 194, 205, 206, 209, 210, 211, 214, 215, 222, 223, 224, 235, 236, 239, 244, 245, 254, 259, 268, 269, 270, 271, 278, 279, 304, 305, 306, 311, 314, 315 or 320, or a complement thereof, wherein the portion comprises at least 15 contiguous nucleotides of that sequence or complement; (c) a polynucleotide that hybridizes to the sequence of (a) or (b) or a complement thereof, under at least low, medium or high stringency conditions; and (d) a polynucleotide comprising a portion of any one of SEQ ID NO: 3, 4, 9, 15, 16, 17, 18, 25, 26, 37, 38, 41, 42, 43, 44, 49, 63, 66, 67, 68, 69, 70, 75, 76, 79, 80, 81, 82, 83, 92, 93, 100, 101, 102, 103, 106, 109, 110, 113, 114, 121, 122, 123, 124, 125, 136, 157, 168, 169, 172, 173, 192, 193, 194, 205, 206, 209, 210, 211, 214, 215, 222, 223, 224, 235, 236, 239, 244, 245, 254, 259, 268, 269, 270, 271, 278, 279, 304, 305, 306, 311, 314, 315 or 320, or a complement thereof, wherein the portion comprises at least 15 contiguous nucleotides of that sequence or complement and hybridizes to a sequence of (a), (b) or (c), or a complement thereof, under at least low, medium or high stringency conditions.

In yet another aspect, the present invention provides a nucleic acid construct comprising a polynucleotide as broadly described above in operable connection with a regulatory element, which is operable in a host cell. In certain embodiments, the construct is in the form of a vector, especially an expression vector.

In still another aspect, the present invention provides isolated host cells containing a nucleic acid construct or vector as broadly described above. In certain advantageous embodiments, the host cells are selected from bacterial cells, yeast cells and insect cells.

In still another aspect, the present invention provides probes for interrogating nucleic acid for the presence of a polynucleotide as broadly described above. These probes generally comprise a nucleotide sequence that hybridizes under at least low stringency conditions to a polynucleotide as broadly described above. In some embodiments, the probes consist essentially of a nucleic acid sequence which corresponds or is complementary to at least a portion of a nucleotide sequence encoding the amino acid sequence set forth in any one of SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326, wherein the portion is at least 15 nucleotides in length. In other embodiments, the probes comprise a nucleotide sequence which is capable of hybridizing to at least a portion of a nucleotide sequence encoding the amino acid sequence set forth in any one of SEQ ID NO: 2, 8, 12, 14, 20, 22, 24, 28, 30, 32, 34, 36, 40, 46, 48, 51, 53, 55, 57, 59, 62, 65, 72, 74, 78, 85, 87, 89, 91, 95, 97, 99, 105, 108, 112, 116, 118, 120, 127, 129, 131, 133, 135, 138, 140, 142, 144, 146, 148, 150, 152, 154, 156, 159, 161, 163, 165, 167, 171, 175, 177, 179, 181, 183, 185, 187, 189, 191, 196, 198, 200, 202, 204, 208, 213, 217, 219, 221, 226, 228, 230, 232, 234, 236, 238, 241, 243, 247, 249, 251, 253, 256, 258, 261, 263, 265, 267, 273, 275, 277, 281, 283, 285, 287, 289, 291, 293, 295, 297, 299, 301, 303, 308, 310, 313, 317, 319, 322, 324 or 326 under at least low, medium or high stringency conditions, wherein the portion is at least 15 nucleotides in length. In still other embodiment, the probes comprise a nucleotide sequence that is capable of hybridizing to at least a portion of any one of SEQ ID NO: 1, 3, 4, 5, 6, 7, 9, 10, 11, 13, 15, 16, 17, 18, 19, 21, 23, 25, 26, 27, 29, 31, 33, 35, 37, 38, 39, 41, 42, 43, 44, 45, 47, 49, 50, 52, 54, 56, 58, 60, 61, 63, 64, 66, 67, 68, 69, 70, 71, 73, 75, 76, 77, 78, 79, 80, 81, 82, 83, 84, 86, 88, 90, 92, 93, 94, 96, 98, 100, 101, 102, 103, 104, 106, 107, 109, 110, 111, 113, 114, 115, 117, 119, 121, 122, 123, 124, 125, 126, 128, 130, 132, 134, 136, 137, 139, 141, 143, 145, 147, 149, 151, 153, 155, 157, 158, 160, 162, 164, 166, 168, 169, 170, 172, 173, 174, 176, 178, 180, 182, 184, 186, 188, 190, 192, 193, 194, 195, 197, 199, 201, 203, 205, 206, 207, 209, 210, 211, 212, 214, 215, 216, 218, 220, 222, 223, 224, 225, 227, 229, 231, 233, 235, 236, 237, 239, 240, 242, 244, 245, 246, 248, 250, 252, 254, 255, 257, 259 260, 262, 264, 266, 268, 269, 270, 271, 272, 274, 276, 278, 279, 280, 282, 284, 286, 288, 290, 292, 294, 296, 298, 300, 302, 304, 305, 306, 307, 309, 311, 312, 314, 315, 316, 318, 320 321, 323 or 325 under at least low, medium or high stringency conditions, wherein the portion is at least 15 nucleotides in length. Representative probes for detecting the endotoxemia marker polynucleotides according to the resent invention are set forth in SEQ ID NO: 326-2315 (see Table 2).

In a related aspect, the invention provides a solid or semi-solid support comprising at least one nucleic acid probe as broadly described above immobilized thereon. In some embodiments, the solid or semi-solid support comprises a spatial array of nucleic acid probes immobilized thereon.

In a further aspect, the present invention provides isolated polypeptides, referred to herein as "endotoxemia marker polypeptides," which are generally selected from: (i) a polypeptide comprising an amino acid sequence that shares at least 50% (and at least 51% to at least 99% and all integer percentages in between) sequence similarity with a polypeptide expression product of an endotoxemia marker gene as broadly described above, for example, especially an endotoxemia marker gene that comprises a nucleotide sequence that shares at least 50% (and at least 51% to at least 99% and all integer percentages in between) sequence identity with the sequence set forth in any one of SEQ ID NO: 3, 4, 9, 15, 16, 17, 18, 25, 26, 37, 38, 41, 42, 43, 44, 49, 63, 66, 67, 68, 69, 70, 75, 76, 79, 80, 81, 82, 83, 92, 93, 100, 101, 102, 103, 106, 109, 110, 113, 114, 121, 122, 123, 124, 125, 136, 157, 168, 169, 172, 173, 192, 193, 194, 205, 206, 209, 210, 211, 214, 215, 222, 223, 224, 235, 236, 239, 244, 245, 254, 259, 268, 269, 270, 271, 278, 279, 304, 305, 306, 311, 314, 315 or 320; (ii) a portion of the polypeptide according to (i) wherein the portion comprises at least 5 contiguous amino acid residues of that polypeptide; (iii) a polypeptide comprising an amino acid sequence that shares at least 30% similarity (and at least 31% to at least 99% and all integer percentages in between) with at least 15 contiguous amino acid residues of the polypeptide according to (i); and (iv) a polypeptide comprising an amino acid sequence that is immuno-interactive with an antigen-binding molecule that is immuno-interactive with a sequence of (i), (ii) or (iii).

Still a further aspect of the present invention provides an antigen-binding molecule that is immuno-interactive with an endotoxemia marker polypeptide as broadly described above.

In a related aspect, the invention provides a solid or semi-solid support comprising at least one antigen-binding molecule as broadly described above immobilized thereon. In some embodiments, the solid or semi-solid support comprises a spatial array of antigen-binding molecules immobilized thereon.

Still another aspect of the invention provides the use of one or more endotoxemia marker polynucleotides as broadly described above, or the use of one or more probes as broadly described above, or the use of one or more endotoxemia marker polypeptides as broadly described above, or the use of one or more antigen-binding molecules as broadly described above, in the manufacture of a kit for diagnosing the presence of an endotoxemia-related condition in a subject.

In still other aspects, the invention is directed to the use of the diagnostic methods as broadly described above, or one or more endotoxemia marker polynucleotides as broadly described above, or the use of one or more probes as broadly described above, or the use of one or more endotoxemia marker polypeptides as broadly described above, or the use of one or more antigen-binding molecules as broadly described above, for diagnosing an endotoxemia-related condition animals (vertebrates), mammals, non-human mammals, animals, such as horses involved in load bearing or athletic activities (e.g., races) and pets (e.g., dogs and cats).

The aspects of the invention are directed to animals (vertebrates), mammals, non-human mammals, animals, such as horses involved in load bearing or athletic activities (e.g., races) and pets (e.g., dogs and cats).

DETAILED DESCRIPTION OF THE INVENTION

1. Definitions

Figure 1:
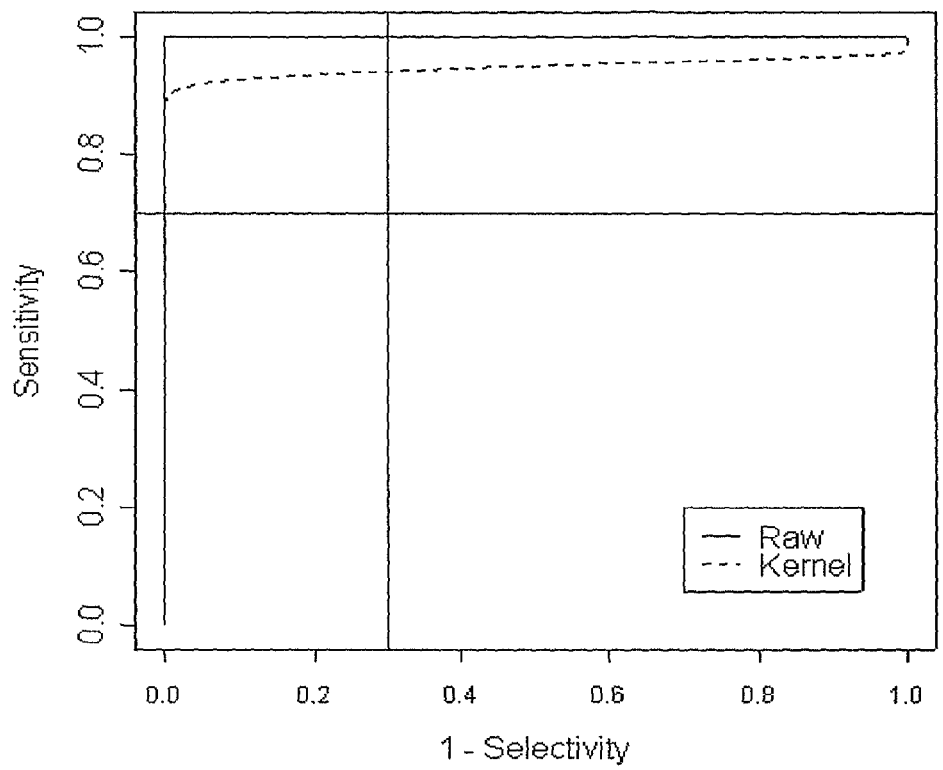
FIG. 1 is a graphical representation of a receiver operating curve (ROC) for comparison of gene expression 24 hours post-induction. The ROC curve generated from these data demonstrated that 24 hours post-induction, was well separated from 0 hours. The sensitivity and selectivity using two principal components are 1.00 and 1.00 respectively.

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, preferred methods and materials are described. For the purposes of the present invention, the following terms are defined below.

The articles "a" and "an" are used herein to refer to one or to more than one (i.e., to at least one) of the grammatical object of the article. By way of example, "an element" means one element or more than one element.

The term "aberrant expression," as used herein to describe the expression of an endotoxemia marker gene, refers to the overexpression or underexpression of an endotoxemia marker gene relative to the level of expression of the endotoxemia marker gene or variant thereof in cells obtained from a healthy subject or from a subject lacking endotoxemia, and/or to a higher or lower level of an endotoxemia marker gene product (e.g., transcript or polypeptide) in a tissue sample or body fluid obtained from a healthy subject or from a subject lacking endotoxemia. In particular, an endotoxemia marker gene is aberrantly expressed if the level of expression of the endotoxemia marker gene is higher by at least about 10%, 20%, 30%, 40%, 50%, 60%, 70%, 80% or 90%, or even at least about 100%, 200%, 300%, 400%, 500%, 600%, 700%, 800%, 900% or 1000%, or lower by at least about 10%, 20%, 30% 40%, 50%, 60%, 70%, 80%, 90%, 92%, 94%, 96%, 97%, 98% or 99%, or even an at least about 99.5%, 99.9%, 99.95%, 99.99%, 99.995% or 99.999% than the level of expression of the endotoxemia marker gene by cells obtained from a healthy subject or from a subject without endotoxemia, and/or relative to the level of expression of the endotoxemia marker gene in a tissue sample or body fluid obtained from a healthy subject or from a subject without endotoxemia.

By "about" is meant a quantity, level, value, number, frequency, percentage, dimension, size, amount, weight or length that varies by as much as 30, 25, 20, 25, 10, 9, 8, 7, 6, 5, 4, 3, 2 or 1% to a reference quantity, level, value, number, frequency, percentage, dimension, size, amount, weight or length.

The term "amplicon" refers to a target sequence for amplification, and/or the amplification products of a target sequence for amplification. In certain other embodiments an "amplicon" may include the sequence of probes or primers used in amplification.

By "antigen-binding molecule" is meant a molecule that has binding affinity for a target antigen. It will be understood that this term extends to immunoglobulins, immunoglobulin fragments and non-immunoglobulin derived protein frameworks that exhibit antigen-binding activity.

As used herein, the term "binds specifically," "specifically immuno-interactive" and the like when referring to an antigen-binding molecule refers to a binding reaction which is determinative of the presence of an antigen in the presence of a heterogeneous population of proteins and other biologics. Thus, under designated immunoassay conditions, the specified antigen-binding molecules bind to a particular antigen and do not bind in a significant amount to other proteins or antigens present in the sample. Specific binding to an antigen under such conditions may require an antigen-binding molecule that is selected for its specificity for a particular antigen. For example, antigen-binding molecules can be raised to a selected protein antigen, which bind to that antigen but not to other proteins present in a sample. A variety of immunoassay formats may be used to select antigen-binding molecules specifically immuno-interactive with a particular protein. For example, solid-phase ELISA immunoassays are routinely used to select monoclonal antibodies specifically immuno-interactive with a protein. See Harlow and Lane (1988) Antibodies, A Laboratory Manual, Cold Spring Harbor Publications, New York, for a description of immunoassay formats and conditions that can be used to determine specific immunoreactivity.

By "biologically active portion" is meant a portion of a full-length parent peptide or polypeptide which portion retains an activity of the parent molecule. As used herein, the term "biologically active portion" includes deletion mutants and peptides, for example of at least about 8, 9, 10, 11, 12, 13, 14, 15, 16, 17, 18, 19, 20, 21, 22, 23, 24, 25, 30, 40, 50, 60, 70, 80, 90, 100, 120, 150, 300, 400, 500, 600, 700, 800, 900, 1000 contiguous amino acids, which comprise an activity of a parent molecule. Portions of this type may be obtained through the application of standard recombinant nucleic acid techniques or synthesized using conventional liquid or solid phase synthesis techniques. For example, reference may be made to solution synthesis or solid phase synthesis as described, for example, in Chapter 9 entitled "*Peptide Synthesis*" by Atherton and Shephard which is included in a publication entitled "*Synthetic Vaccines*" edited by Nicholson and published by Blackwell Scientific Publications. Alternatively, peptides can be produced by digestion of a peptide or polypeptide of the invention with proteinases such as endoLys-C, endoArg-C, endoGlu-C and *staphylococcus* V8-protease. The digested fragments can be purified by, for example, high performance liquid chromatographic (HPLC) techniques. Recombinant nucleic acid techniques can also be used to produce such portions.

The term "biological sample" as used herein refers to a sample that may be extracted, untreated, treated, diluted or concentrated from an animal. The biological sample may include a biological fluid such as whole blood, serum, plasma, saliva, urine, sweat, ascitic fluid, peritoneal fluid, synovial fluid, amniotic fluid, cerebrospinal fluid, tissue biopsy, and the like. In certain embodiments, the biological sample is blood, especially peripheral blood.

As used herein, the term "cis-acting sequence," "cis-acting element" or "cis-regulatory region" or "regulatory region" or similar term shall be taken to mean any sequence of nucleotides, which when positioned appropriately relative to an expressible genetic sequence, is capable of regulating, at least in part, the expression of the genetic sequence. Those skilled in the art will be aware that a cis-regulatory region may be capable of activating, silencing, enhancing, repressing or otherwise altering the level of expression and/or cell-type-specificity and/or developmental specificity of a gene sequence at the transcriptional or post-transcriptional level. In certain embodiments of the present invention, the cis-acting sequence is an activator sequence that enhances or stimulates the expression of an expressible genetic sequence.

Throughout this specification, unless the context requires otherwise, the words "comprise," "comprises" and "comprising" will be understood to imply the inclusion of a stated step or element or group of steps or elements but not the exclusion of any other step or element or group of steps or elements.

By "corresponds to" or "corresponding to" is meant a polynucleotide (a) having a nucleotide sequence that is substantially identical or complementary to all or a portion of a reference polynucleotide sequence or (b) encoding an amino acid sequence identical to an amino acid sequence in a peptide or protein. This phrase also includes within its scope a peptide or polypeptide having an amino acid sequence that is substantially identical to a sequence of amino acids in a reference peptide or protein.

By "effective amount", in the context of treating or preventing a condition is meant the administration of that amount of active to an individual in need of such treatment or prophylaxis, either in a single dose or as part of a series, that is effective for the prevention of incurring a symptom, holding in check such symptoms, and/or treating existing symptoms, of that condition. The effective amount will vary depending upon the health and physical condition of the individual to be treated, the taxonomic group of individual to be treated, the formulation of the composition, the assessment of the medical situation, and other relevant factors. It is expected that the amount will fall in a relatively broad range that can be determined through routine trials.

The terms "expression" or "gene expression" refer to either production of RNA message or translation of RNA message into proteins or polypeptides. Detection of either types of gene expression in use of any of the methods described herein are part of the invention.

By "expression vector" is meant any autonomous genetic element capable of directing the transcription of a polynucleotide contained within the vector and suitably the synthesis of a peptide or polypeptide encoded by the polynucleotide. Such expression vectors are known to practitioners in the art.

As used herein, the term "functional activity" generally refers to the ability of a molecule (e.g., a transcript or polypeptide) to perform its designated function including a biological, enzymatic, or therapeutic function. In certain embodiments, the functional activity of a molecule corresponds to its specific activity as determined by any suitable assay known in the art.

The term "gene" as used herein refers to any and all discrete coding regions of the cell's genome, as well as associated non-coding and regulatory regions. The gene is also intended to mean the open reading frame encoding specific polypeptides, introns, and adjacent 5' and 3' non-coding nucleotide sequences involved in the regulation of expression. In this regard, the gene may further comprise control signals such as promoters, enhancers, termination and/or polyadenylation signals that are naturally associated with a given gene, or heterologous control signals. The DNA sequences may be cDNA or genomic DNA or a fragment thereof. The gene may be introduced into an appropriate vector for extrachromosomal maintenance or for integration into the host.

By "high density polynucleotide arrays" and the like is meant those arrays that contain at least 400 different features per cm$^2$.

The phrase "high discrimination hybridization conditions" refers to hybridization conditions in which single base mismatch may be determined.

By "housekeeping gene" is meant a gene that is expressed in virtually all cells since it is fundamental to the any cell's functions (e.g., essential proteins and RNA molecules).

"Hybridization" is used herein to denote the pairing of complementary nucleotide sequences to produce a DNA-DNA hybrid or a DNA-RNA hybrid. Complementary base sequences are those sequences that are related by the base-pairing rules. In DNA, A pairs with T and C pairs with G. In RNA, U pairs with A and C pairs with G. In this regard, the terms "match" and "mismatch" as used herein refer to the hybridization potential of paired nucleotides in complementary nucleic acid strands. Matched nucleotides hybridize efficiently, such as the classical A-T and G-C base pair mentioned above. Mismatches are other combinations of nucleotides that do not hybridize efficiently.

The phrase "hybridizing specifically to" and the like refer to the binding, duplexing, or hybridizing of a molecule only to a particular nucleotide sequence under stringent conditions when that sequence is present in a complex mixture (e.g., total cellular) DNA or RNA.

Reference herein to "immuno-interactive" includes reference to any interaction, reaction, or other form of association between molecules and in particular where one of the molecules is, or mimics, a component of the immune system.

By "isolated" is meant material that is substantially or essentially free from components that normally accompany it in its native state. For example, an "isolated polynucleotide", as used herein, refers to a polynucleotide, which has been purified from the sequences which flank it in a naturally-occurring state, e.g., a DNA fragment which has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment, and from association with other components of the cell, i.e., it is not associated with in vivo substances.

By "marker gene" is meant a gene that imparts a distinct phenotype to cells expressing the marker gene and thus allows such transformed cells to be distinguished from cells that do not have the marker. A selectable marker gene confers a trait for which one can 'select' based on resistance to a selective agent (e.g., a herbicide, antibiotic, radiation, heat, or other treatment damaging to untransformed cells). A screenable marker gene (or reporter gene) confers a trait that one can identify through observation or testing, i.e., by 'screening' (e.g. β-glucuronidase, luciferase, or other enzyme activity not present in untransformed cells).

As used herein, a "naturally-occurring" nucleic acid molecule refers to a RNA or DNA molecule having a nucleotide sequence that occurs in nature. For example a naturally-occurring nucleic acid molecule can encode a protein that occurs in nature.

By "obtained from" is meant that a sample such as, for example, a nucleic acid extract or polypeptide extract is isolated from, or derived from, a particular source. For instance, the extract may be isolated directly from a biological fluid or tissue of the subject.

The term "oligonucleotide" as used herein refers to a polymer composed of a multiplicity of nucleotide residues (deoxyribonucleotides or ribonucleotides, or related structural variants or synthetic analogues thereof, including nucleotides with modified or substituted sugar groups and the like) linked via phosphodiester bonds (or related structural variants or synthetic analogues thereof). Thus, while the term "oligonucleotide" typically refers to a nucleotide polymer in which the nucleotide residues and linkages between them are naturally-occurring, it will be understood that the term also includes within its scope various analogues including, but not restricted to, peptide nucleic acids (PNAs), phosphorothioate, phosphorodithioate, phosphoroselenoate, phosphorodiselenoate, phosphoroanilothioate, phosphoraniladate, phosphoroamidate, methyl phosphonates, 2-O-methyl ribonucleic acids, and the like. The exact size of the molecule can vary depending on the particular application. Oligonucleotides are a polynucleotide subset with 200 bases or fewer in length. Preferably, oligonucleotides are 10 to 60 bases in length and most preferably 12, 13, 14, 15, 16, 17, 18, 19, or 20 to 40 bases in length.

Oligonucleotides are usually single stranded, e.g., for probes; although oligonucleotides may be double stranded, e.g., for use in the construction of a variant nucleic acid sequence. Oligonucleotides of the invention can be either sense or antisense oligonucleotides.

The term "oligonucleotide array" refers to a substrate having oligonucleotide probes with different known sequences deposited at discrete known locations associated with its surface. For example, the substrate can be in the form of a two dimensional substrate as described in U.S. Pat. No. 5,424,186. Such substrate may be used to synthesize two-dimensional spatially addressed oligonucleotide (matrix) arrays. Alternatively, the substrate may be characterized in that it forms a tubular array in which a two dimensional planar sheet is rolled into a three-dimensional tubular configuration. The substrate may also be in the form of a microsphere or bead connected to the surface of an optic fiber as, for example, disclosed by Chee et al. in WO 00/39587. Oligonucleotide arrays have at least two different features and a density of at least 400 features per $cm^2$. In certain embodiments, the arrays can have a density of about 500, at least one thousand, at least 10 thousand, at least 100 thousand, at least one million or at least 10 million features per $cm^2$. For example, the substrate may be silicon or glass and can have the thickness of a glass microscope slide or a glass cover slip, or may be composed of other synthetic polymers. Substrates that are transparent to light are useful when the method of performing an assay on the substrate involves optical detection. The term also refers to a probe array and the substrate to which it is attached that form part of a wafer.

The term "operably connected" or "operably linked" as used herein means placing a structural gene under the regulatory control of a promoter, which then controls the transcription and optionally translation of the gene. In the construction of heterologous promoter/structural gene combinations, it is generally preferred to position the genetic sequence or promoter at a distance from the gene transcription start site that is approximately the same as the distance between that genetic sequence or promoter and the gene it controls in its natural setting; i.e. the gene from which the genetic sequence or promoter is derived. As is known in the art, some variation in this distance can be accommodated without loss of function. Similarly, the preferred positioning of a regulatory sequence element with respect to a heterologous gene to be placed under its control is defined by the positioning of the element in its natural setting; i.e., the genes from which it is derived.

The term "pathogen" is used herein in its broadest sense to refer to an organism or an infectious agent whose infection of cells of viable animal tissue elicits a disease response.

The term "polynucleotide" or "nucleic acid" as used herein designates mRNA, RNA, cRNA, cDNA or DNA. The term typically refers to polymeric form of nucleotides of at least 10 bases in length, either ribonucleotides or deoxynucleotides or a modified form of either type of nucleotide. The term includes single and double stranded forms of DNA.

The terms "polynucleotide variant" and "variant" refer to polynucleotides displaying substantial sequence identity with a reference polynucleotide sequence or polynucleotides that hybridize with a reference sequence under stringent conditions that are defined hereinafter. These terms also encompass polynucleotides in which one or more nucleotides have been added or deleted, or replaced with different nucleotides. In this regard, it is well understood in the art that certain alterations inclusive of mutations, additions, deletions and substitutions can be made to a reference polynucleotide whereby the altered polynucleotide retains a biological function or activity of the reference polynucleotide. The terms "polynucleotide variant" and "variant" also include naturally-occurring allelic variants.

"Polypeptide", "peptide" and "protein" are used interchangeably herein to refer to a polymer of amino acid residues and to variants and synthetic analogues of the same. Thus, these terms apply to amino acid polymers in which one or more amino acid residues is a synthetic non-naturally-occurring amino acid, such as a chemical analogue of a corresponding naturally-occurring amino acid, as well as to naturally-occurring amino acid polymers.

The term "polypeptide variant" refers to polypeptides which are distinguished from a reference polypeptide by the addition, deletion or substitution of at least one amino acid residue. In certain embodiments, one or more amino acid residues of a reference polypeptide are replaced by different amino acids. It is well understood in the art that some amino acids may be changed to others with broadly similar properties without changing the nature of the activity of the polypeptide (conservative substitutions) as described hereinafter.

By "primer" is meant an oligonucleotide which, when paired with a strand of DNA, is capable of initiating the synthesis of a primer extension product in the presence of a suitable polymerizing agent. The primer is preferably single-stranded for maximum efficiency in amplification but can alternatively be double-stranded. A primer must be sufficiently long to prime the synthesis of extension products in the presence of the polymerization agent. The length of the primer depends on many factors, including application, temperature to be employed, template reaction conditions, other reagents, and source of primers. For example, depending on the complexity of the target sequence, the primer may be at least about 5, 6, 7, 8, 9, 10, 11, 12, 13, 14, 15, 16, 17, 18, 19, 20, 21, 22, 23, 24, 25, 26, 27, 28, 29, 30, 35, 40, 50, 75, 100, 150, 200, 300, 400, 500, to one base shorter in length than the template sequence at the 3' end of the primer to allow extension of a nucleic acid chain, though the 5' end of the primer may extend in length beyond the 3' end of the template sequence. In certain embodiments, primers can be large polynucleotides, such as from about 35 nucleotides to several kilobases or more. Primers can be selected to be "substantially complementary" to the sequence on the template to which it is designed to hybridize and serve as a site for the initiation of synthesis. By "substantially complementary", it is meant that the primer is sufficiently complementary to hybridize with a target polynucleotide. Desirably, the primer contains no mismatches with the template to which it is designed to hybridize but this is not essential. For example, non-complementary nucleotide residues can be attached to the 5' end of the primer, with the remainder of the primer sequence being complementary to the template. Alternatively, non-complementary nucleotide residues or a stretch of non-complementary nucleotide residues can be interspersed into a primer, provided that the primer sequence has sufficient complementarity with the sequence of the template to hybridize therewith and thereby form a template for synthesis of the extension product of the primer.

"Probe" refers to a molecule that binds to a specific sequence or sub-sequence or other moiety of another molecule. Unless otherwise indicated, the term "probe" typically refers to a polynucleotide probe that binds to another polynucleotide, often called the "target polynucleotide", through complementary base pairing. Probes can bind target polynucleotides lacking complete sequence complementarity with the probe, depending on the stringency of the hybridization conditions. Probes can be labeled directly or indirectly and include primers within their scope.

The term "recombinant polynucleotide" as used herein refers to a polynucleotide formed in vitro by the manipulation of nucleic acid into a form not normally found in nature. For example, the recombinant polynucleotide may be in the form of an expression vector. Generally, such expression vectors include transcriptional and translational regulatory nucleic acid operably linked to the nucleotide sequence.

By "recombinant polypeptide" is meant a polypeptide made using recombinant techniques, i.e., through the expression of a recombinant or synthetic polynucleotide.

By "regulatory element" or "regulatory sequence" is meant nucleic acid sequences (e.g., DNA) necessary for expression of an operably linked coding sequence in a particular host cell. The regulatory sequences that are suitable for prokaryotic cells for example, include a promoter, and optionally a cis-acting sequence such as an operator sequence and a ribosome binding site. Control sequences that are suitable for eukaryotic cells include promoters, polyadenylation signals, transcriptional enhancers, translational enhancers, leader or trailing sequences that modulate mRNA stability, as well as targeting sequences that target a product encoded by a transcribed polynucleotide to an intracellular compartment within a cell or to the extracellular environment.

The term "sequence identity" as used herein refers to the extent that sequences are identical on a nucleotide-by-nucleotide basis or an amino acid-by-amino acid basis over a window of comparison. Thus, a "percentage of sequence identity" is calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, H is, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. For the purposes of the present invention, "sequence identity" will be understood to mean the "match percentage" calculated by the DNASIS computer program (Version 2.5 for windows; available from Hitachi Software engineering Co., Ltd., South San Francisco, Calif., USA) using standard defaults as used in the reference manual accompanying the software.

"Similarity" refers to the percentage number of amino acids that are identical or constitute conservative substitutions as defined in Table A infra. Similarity may be determined using sequence comparison programs such as GAP (Deveraux et al. 1984, *Nucleic Acids Research* 12, 387-395). In this way, sequences of a similar or substantially different length to those cited herein might be compared by insertion of gaps into the alignment, such gaps being determined, for example, by the comparison algorithm used by GAP.

Terms used to describe sequence relationships between two or more polynucleotides or polypeptides include "reference sequence," "comparison window," "sequence identity," "percentage of sequence identity" and "substantial identity". A "reference sequence" is at least 12 but frequently 15 to 18 and often at least 25 monomer units, inclusive of nucleotides and amino acid residues, in length. Because two polynucleotides may each comprise (1) a sequence (i.e., only a portion of the complete polynucleotide sequence) that is similar between the two polynucleotides, and (2) a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window" refers to a conceptual segment of at least 6 contiguous positions, usually about 50 to about 100, more usually about 100 to about 150 in which a sequence is compared to a reference sequence of the same number of contiguous positions after the two sequences are optimally aligned. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., 1997, *Nucl. Acids Res.* 25:3389. A detailed discussion of sequence analysis can be found in Unit 19.3 of Ausubel et al., "Current Protocols in Molecular Biology", John Wiley & Sons Inc, 1994-1998, Chapter 15.

The terms "subject" or "individual" or "patient", used interchangeably herein, refer to any subject, particularly a vertebrate subject, and even more particularly a mammalian subject, for whom therapy or prophylaxis is desired. Suitable vertebrate animals that fall within the scope of the invention include, but are not restricted to, primates, avians, livestock animals (e.g., sheep, cows, horses, donkeys, pigs), laboratory test animals (e.g., rabbits, mice, rats, guinea pigs, hamsters), companion animals (e.g., cats, dogs) and captive wild animals (e.g., foxes, deer, dingoes). A preferred subject is an equine animal in need of treatment or prophylaxis of endotoxemia. However, it will be understood that the aforementioned terms do not imply that symptoms are present.

The phrase "substantially similar affinities" refers herein to target sequences having similar strengths of detectable hybridization to their complementary or substantially complementary oligonucleotide probes under a chosen set of stringent conditions.

The term "template" as used herein refers to a nucleic acid that is used in the creation of a complementary nucleic acid strand to the "template" strand. The template may be either RNA and/or DNA, and the complementary strand may also be RNA and/or DNA. In certain embodiments, the complementary strand may comprise all or part of the complementary sequence to the "template," and/or may include mutations so that it is not an exact, complementary strand to the "template". Strands that are not exactly complementary to the template strand may hybridize specifically to the template strand in detection assays described here, as well as other assays known in the art, and such complementary strands that can be used in detection assays are part of the invention.

The term "transformation" means alteration of the genotype of an organism, for example a bacterium, yeast, mammal, avian, reptile, fish or plant, by the introduction of a foreign or endogenous nucleic acid.

The term "treat" is meant to include both therapeutic and prophylactic treatment.

By "vector" is meant a polynucleotide molecule, suitably a DNA molecule derived, for example, from a plasmid, bacteriophage, yeast, virus, mammal, avian, reptile or fish into which a polynucleotide can be inserted or cloned. A vector preferably contains one or more unique restriction sites and can be capable of autonomous replication in a defined host cell including a target cell or tissue or a progenitor cell or tissue thereof, or be integrable with the genome of the defined host such that the cloned sequence is reproducible. Accordingly, the vector can be an autonomously replicating vector, i.e., a vector that exists as an extrachromosomal entity, the replication of which is independent of chromosomal replication, e.g., a linear or closed circular plasmid, an extrachromosomal element, a minichromosome, or an artificial chromosome. The vector can contain any means for assuring self-replication. Alternatively, the vector can be one which, when introduced into the host cell, is integrated into the genome and replicated together with the chromosome(s) into which it has been integrated. A vector system can comprise a single vector or plasmid, two or more vectors or plasmids, which together contain the total DNA to be introduced into the genome of the host cell, or a transposon. The choice of the vector will typically depend on the compatibility of the vector with the host cell into which the vector is to be introduced. The vector can also include a selection marker such as an antibiotic resistance gene that can be used for selection of suitable transformants. Examples of such resistance genes are known to those of skill in the art.

The terms "wild-type" and "normal" are used interchangeably to refer to the phenotype that is characteristic of most of the members of the species occurring naturally and contrast for example with the phenotype of a mutant.

2. Abbreviations

The following abbreviations are used throughout the application:
nt=nucleotide
nts=nucleotides
aa=amino acid(s)
kb=kilobase(s) or kilobase pair(s)
kDa=kilodalton(s)
d=day
h=hour
s=seconds 3. Markers of Endotoxemia and Uses Therefor The present invention concerns the early detection, diagnosis, or prognosis of endotoxemia or its sequelae (also referred to herein as "endotoxemia-related conditions"). Markers of endotoxemia, in the form of RNA molecules of specified sequences, or polypeptides expressed from these RNA molecules in cells, especially in blood cells, and more especially in peripheral blood cells, of subjects with or susceptible to endotoxemia, are disclosed. These markers are indicators of endotoxemia-related conditions and, when differentially expressed as compared to their expression in normal subjects or in subjects lacking endotoxemia-related conditions, are diagnostic for the presence of those conditions in tested subjects. Such markers provide considerable advantages over the prior art in this field. In certain advantageous embodiments where leukocytes (e.g., peripheral blood cells) are used for the analysis, it is possible to diagnose active endotoxemia-related conditions before serum antibodies to endotoxin, or endotoxaemia-causing agent are detected.

It will be apparent that the nucleic acid sequences disclosed herein will find utility in a variety of applications in detection, diagnosis, prognosis and treatment of endotoxemia-related conditions. Examples of such applications within the scope of the present disclosure comprise amplification of endotoxemia markers using specific primers, detection of endotoxemia markers by hybridization with oligonucleotide probes, incorporation of isolated nucleic acids into vectors, expression of vector-incorporated nucleic acids as RNA and protein, and development of immunological reagents corresponding to marker encoded products.

The identified endotoxemia markers may in turn be used to design specific oligonucleotide probes and primers. Such probes and primers may be of any length that would specifically hybridize to the identified marker gene sequences and may be at least about 10, 11, 12, 13, 14, 15, 16, 17, 18, 19, 20, 21, 22, 23, 24, 25, 26, 27, 28, 29, 30, 35, 40, 50, 75, 100, 150, 200, 300, 400, 500 nucleotides in length and in the case of probes, up to the full length of the sequences of the marker genes identified herein. Probes may also include additional sequence at their 5' and/or 3' ends so that they extent beyond the target sequence with which they hybridize.

When used in combination with nucleic acid amplification procedures, these probes and primers enable the rapid analysis of biological samples (e.g., peripheral blood samples) for detecting marker genes or for detecting or quantifying marker gene transcripts. Such procedures include any method or technique known in the art or described herein for duplicating or increasing the number of copies or amount of a target nucleic acid or its complement.

The identified markers may also be used to identify and isolate full-length gene sequences, including regulatory elements for gene expression, from genomic DNA libraries, which are suitably but not exclusively of equine origin. The cDNA sequences identified in the present disclosure may be used as hybridization probes to screen genomic DNA libraries by conventional techniques. Once partial genomic clones have been identified, full-length genes may be isolated by "chromosomal walking" (also called "overlap hybridization") using, for example, the method disclosed by Chinault & Carbon (1979, *Gene* 5: 111-126). Once a partial genomic clone has been isolated using a cDNA hybridization probe, non-repetitive segments at or near the ends of the partial genomic clone may be used as hybridization probes in further genomic library screening, ultimately allowing isolation of entire gene sequences for the endotoxemia markers of interest. It will be recognized that full-length genes may be obtained using the full-length or partial cDNA sequences or short expressed sequence tags (ESTs) described in this disclosure using standard techniques as disclosed for example by Sambrook, et al. (MOLECULAR CLONING. A LABORATORY MANUAL (Cold Spring Harbor Press, 1989) and Ausubel et al., (CURRENT PROTOCOLS IN MOLECULAR BIOLOGY, John Wiley & Sons, Inc. 1994). In addition, the disclosed sequences may be used to identify and isolate full-length cDNA sequences using standard techniques as disclosed, for example, in the above-referenced texts. Sequences identified and isolated by such means may be useful in the detection of the endotoxemia marker genes using the detection methods described herein, and are part of the invention.

One of ordinary skill in the art could select segments from the identified marker genes for use in the different detection, diagnostic, or prognostic methods, vector constructs, antigen-binding molecule production, kit, and/or any of the embodiments described herein as part of the present invention. Marker gene sequences that are desirable for use in the invention are those set fort in SEQ ID NO: 1, 3, 5, 7, 8, 10, 12, 14, 16, 17, 18, 20, 22, 24, 26, 27, 28, 30, 32, 34, 35, 36, 37, 38, 39, 40, 41, 42, 43, 44, 45, 46, 47, 48, 49, 50, 52, 54, 55, 56 or 57 (see Table 1).

4. Nucleic Acid Molecules of the Invention

As described in the Examples and in Tables 1, the present disclosure provides 179 markers of endotoxemia, identified by GeneChip® analysis of blood obtained from normal horses and from horses with clinical evidence of an endotoxemia-related condition. Of the 179 markers identified, 121 comprise coding regions sequences (see the markers relating to SEQ ID NO: 1, 5, 6, 7, 11, 13, 19, 21, 23, 27, 29, 31, 33, 35, 39, 45, 47, 50, 52, 54, 56, 58, 60, 61, 64, 71, 73, 77, 78, 84, 86, 88, 90, 94, 96, 98, 102, 103, 104, 107, 111, 115, 117, 119, 126, 128, 130, 132, 134, 137, 139, 141, 143, 145, 147, 149, 151, 153, 155, 158, 160, 162, 164, 166, 170, 174, 176, 178, 180, 182, 184, 186, 188, 190, 195, 197, 199, 201, 203, 207, 212, 216, 218, 220, 225, 227, 229, 231, 233, 237, 240, 242, 246, 248, 250, 252, 255, 257, 260, 262, 264, 266, 272, 274, 276, 280, 282, 284, 286, 288, 290, 292, 294, 296, 298, 300, 302, 307, 309, 312, 316, 318, 321, 323 or 325) and 58 comprise 5' and/or 3' untranslated sequences only (see the markers relating to SEQ ID NO: 3, 4, 9, 15, 16, 17, 18, 25, 26, 37, 38, 41, 42, 43, 44, 49, 63, 66, 67, 68, 69, 70, 75, 76, 79, 80, 81, 82, 83, 92, 93, 100, 101, 102, 103, 106, 109, 110, 113, 114, 121, 122, 123, 124, 125, 136, 157, 168, 169, 172, 173, 192, 193, 194, 205, 206, 209, 210, 211, 214, 215, 222, 223, 224, 235, 236, 239, 244, 245, 254, 259, 268, 269, 270, 271, 278, 279, 304, 305, 306, 311, 314, 315 or 320). These sequences, which are presented in Table 1, are diagnostic for the presence, stage or degree of an endotoxemia-related condition (also referred to herein as "endotoxemia marker polynucleotides"). Sequence analysis has revealed that the endotoxaemia marker genes can be classified into subgroups. For example, several endotoxaemia marker genes encode membrane associated polypeptides involved in the immune response (e.g., SEQ ID NO. 59, 219, 230, 253, 285, and 295), whereas others encode cytoplasm associated polypeptides (e.g., SEQ ID NO: 217, 241, 247, 265, 267, 287, and 291), while still others encode extracellular polypeptides (e.g., SEQ ID NO: 30, 85, 108, 127, 140, and 226), whereas still others encode nuclear polypeptides (e.g., 8, 12, 20, 28, 40, 55, 281, 283 and 313) and still others encode cytoskeleton molecules (e.g., SEQ ID NO: 105 and 213).

In accordance with the present invention, the sequences of isolated nucleic acids disclosed herein find utility inter alia as hybridization probes or amplification primers. These nucleic acids may be used, for example, in diagnostic evaluation of biological samples or employed to clone full-length cDNAs or genomic clones corresponding thereto. In certain embodiments, these probes and primers represent oligonucleotides, which are of sufficient length to provide specific hybridization to a RNA or DNA sample extracted from the biological sample. The sequences typically will be about 10-20 nucleotides, but may be longer. Longer sequences, e.g., of about 30, 40, 50, 100, 500 and even up to full-length, are desirable for certain embodiments.

Nucleic acid molecules having contiguous stretches of about 10, 15, 17, 20, 30, 40, 50, 60, 75 or 100 or 500 nucleotides of a sequence set forth in any one of SEQ ID NO: 1, 3, 5, 7, 8, 10, 12, 14, 16, 17, 18, 20, 22, 24, 26, 27, 28, 30, 32, 34, 35, 36, 37, 38, 39, 40, 41, 42, 43, 44, 45, 46, 47, 48, 49, 50, 52, 54, 55, 56 or 57 are contemplated. Molecules that are complementary to the above mentioned sequences and that bind to these sequences under high stringency conditions are also contemplated. These probes are useful in a variety of hybridization embodiments, such as Southern and northern blotting. In some cases, it is contemplated that probes may be used that hybridize to multiple target sequences without compromising their ability to effectively diagnose an endotoxemia-related condition. In general, it is contemplated that the hybridization probes described herein are useful both as reagents in solution hybridization, as in PCR, for detection of expression of corresponding genes, as well as in embodiments employing a solid phase.

Various probes and primers may be designed around the disclosed nucleotide sequences. For example, in certain embodiments, the sequences used to design probes and primers may include repetitive stretches of adenine nucleotides (poly-A tails) normally attached at the ends of the RNA for the identified marker genes. In other embodiments, probes and primers may be specifically designed to not include these or other segments from the identified marker genes, as one of ordinary skilled in the art may deem certain segments more suitable for use in the detection methods disclosed. In any event, the choice of primer or probe sequences for a selected application is within the realm of the ordinary skilled practitioner. Illustrative probe sequences for detection of endotoxemia marker genes are presented in Tables 2.

Primers may be provided in double-stranded or single-stranded form, although the single-stranded form is desirable. Probes, while perhaps capable of priming, are designed to bind to a target DNA or RNA and need not be used in an amplification process. In certain embodiments, the probes or primers are labeled with radioactive species ($^{32}P$, $^{14}C$, $^{35}S$, $^{3}H$, or other label), with a fluorophore (e.g., rhodamine, fluorescein) or with a chemillumiscent label (e.g., luciferase).

The present invention provides substantially full-length cDNA sequences as well as EST and partial cDNA sequences that are useful as markers of endotoxemia-related condition. It will be understood, however, that the present disclosure is not limited to these disclosed sequences and is intended particularly to encompass at least isolated nucleic acids that are hybridizable to nucleic acids comprising the disclosed sequences or that are variants of these nucleic acids. For example, a nucleic acid of partial sequence may be used to identify a structurally-related gene or the full-length genomic or cDNA clone from which it is derived. Methods for generating cDNA and genomic libraries which may be used as a target for the above-described probes are known in the art (see, for example, Sambrook et al., 1989, supra and Ausubel et al., 1994, supra). All such nucleic acids as well as the specific nucleic acid molecules disclosed herein are collectively referred to as "endotoxemia marker polynucleotides." Additionally, the present invention includes within its scope isolated or purified expression products of endotoxemia marker polynucleotides (i.e., RNA transcripts and polypeptides).

Accordingly, the present invention encompasses isolated or substantially purified nucleic acid or protein compositions. An "isolated" or "purified" nucleic acid molecule or protein, or biologically active portion thereof, is substantially or essentially free from components that normally accompany or interact with the nucleic acid molecule or protein as found in its naturally occurring environment. Thus, an isolated or purified polynucleotide or polypeptide is substantially free of other cellular material, or culture medium when produced by recombinant techniques, or substantially free of chemical precursors or other chemicals when chemically synthesized. Suitably, an "isolated" polynucleotide is free of sequences (especially protein encoding sequences) that naturally flank the polynucleotide (i.e., sequences located at the 5' and 3' ends of the polynucleotide) in the genomic DNA of the organism from which the polynucleotide was derived. For example, in various embodiments, an isolated endotoxaemia marker polynucleotide can contain less than about 5 kb, 4 kb, 3 kb, 2 kb, 1 kb, 0.5 kb, or 0.1 kb of nucleotide sequences that naturally flank the polynucleotide in genomic DNA of the cell from which the polynucleotide was derived. A polypeptide that is substantially free of cellular material includes preparations of protein having less than about 30%, 20%, 10%, 5%, (by dry weight) of contaminating protein. When the protein of the invention or biologically active portion thereof is recombinantly produced, culture medium suitably represents less than about 30%, 20%, 10%, or 5% (by dry weight) of chemical precursors or non-protein-of-interest chemicals.

The present invention also encompasses portions of the full-length or substantially full-length nucleotide sequences of the endotoxemia marker genes or their transcripts or DNA copies of these transcripts. Portions of an endotoxemia marker nucleotide sequence may encode polypeptide portions or segments that retain the biological activity of the native polypeptide. Alternatively, portions of an endotoxemia marker nucleotide sequence that are useful as hybridization probes generally do not encode amino acid sequences retaining such biological activity. Thus, portions of an endotoxemia marker nucleotide sequence may range from at least about 15, 16, 17, 18, 19, 20, 21, 22, 23, 24, 25, 26, 27, 28, 29, 30, 40, 50, 60, 80, 90, 100 nucleotides, or almost up to the full-length nucleotide sequence encoding the endotoxemia marker polypeptides of the invention.

A portion of an endotoxemia marker nucleotide sequence that encodes a biologically active portion of an endotoxemia marker polypeptide of the invention may encode at least about 5, 6, 7, 8, 9, 10, 11, 12, 13, 14, 15, 16, 17, 18, 19, 20, 21, 22, 23, 24, 25, 30, 40, 50, 60, 70, 80, 90, 100, 120, 150, 300, 400, 500, 600, 700, 800, 900 or 1000, or even at least about 2000, 3000, 4000 or 5000 contiguous amino acid residues, or almost up to the total number of amino acids present in a full-length endotoxemia marker polypeptide. Portions of an endotoxemia marker nucleotide sequence that are useful as hybridization probes or PCR primers generally need not encode a biologically active portion of an endotoxemia marker polypeptide.

Thus, a portion of an endotoxemia marker nucleotide sequence may encode a biologically active portion of an endotoxemia marker polypeptide, or it may be a fragment that can be used as a hybridization probe or PCR primer using standard methods known in the art. A biologically active portion of an endotoxemia marker polypeptide can be prepared by isolating a portion of one of the endotoxemia marker nucleotide sequences of the invention, expressing the encoded portion of the endotoxemia marker polypeptide (e.g., by recombinant expression in vitro), and assessing the activity of the encoded portion of the endotoxemia marker polypeptide. Nucleic acid molecules that are portions of an endotoxemia marker nucleotide sequence comprise at least about 15, 16, 17, 18, 19, 20, 25, 30, 50, 75, 100, 150, 200, 250, 300, 350, 400, 450, 500, 550, 600, or 650 nucleotides, or almost up to the number of nucleotides present in a full-length endotoxemia marker nucleotide sequence.

The invention also contemplates variants of the endotoxemia marker nucleotide sequences. Nucleic acid variants can be naturally-occurring, such as allelic variants (same locus), homologues (different locus), and orthologues (different organism) or can be non naturally-occurring. Naturally occurring variants such as these can be identified with the use of well-known molecular biology techniques, as, for example, with polymerase chain reaction (PCR) and hybridization techniques as known in the art. Non-naturally occurring variants can be made by mutagenesis techniques, including those applied to polynucleotides, cells, or organisms. The variants can contain nucleotide substitutions, deletions, inversions and insertions. Variation can occur in either or both the coding and non-coding regions. The variations can produce both conservative and non-conservative amino acid substitutions (as compared in the encoded product). For nucleotide sequences, conservative variants include those sequences that, because of the degeneracy of the genetic code, encode the amino acid sequence of one of the endotoxemia marker polypeptides of the invention. Variant nucleotide sequences also include synthetically derived nucleotide sequences, such as those generated, for example, by using site-directed mutagenesis but which still encode an endotoxemia marker polypeptide of the invention. Generally, variants of a particular nucleotide sequence of the invention will have at least about 30%, 40% 50%, 55%, 60%, 65%, 70%, generally at least about 75%, 80%, 85%, desirably about 90% to 95% or more, and more suitably about 98% or more sequence identity to that particular nucleotide sequence as determined by sequence alignment programs described elsewhere herein using default parameters.

The endotoxemia marker nucleotide sequences of the invention can be used to isolate corresponding sequences and alleles from other organisms, particularly other mammals, especially other equine species. Methods are readily available in the art for the hybridization of nucleic acid sequences. Coding sequences from other organisms may be isolated according to well known techniques based on their sequence identity with the coding sequences set forth herein. In these techniques all or part of the known coding sequence is used as a probe which selectively hybridizes to other endotoxemia marker coding sequences present in a population of cloned genomic DNA fragments or cDNA fragments (i.e., genomic or cDNA libraries) from a chosen organism. Accordingly, the present invention also contemplates polynucleotides that hybridize to the endotoxemia marker gene nucleotide sequences, or to their complements, under stringency conditions described below. As used herein, the term "hybridizes under low stringency, medium stringency, high stringency, or very high stringency conditions" describes conditions for hybridization and washing. Guidance for performing hybridization reactions can be found in Ausubel et al., (1998, supra), Sections 6.3.1-6.3.6. Aqueous and non-aqueous methods are described in that reference and either can be used. Reference herein to low stringency conditions include and encompass from at least about 1% v/v to at least about 15% v/v formamide and from at least about 1 M to at least about 2 M salt for hybridization at 42° C., and at least about 1 M to at least about 2 M salt for washing at 42° C. Low stringency conditions also may include 1% Bovine Serum Albumin (BSA), 1 mM EDTA, 0.5 M $NaHPO_4$ (pH 7.2), 7% SDS for hybridization at 65° C., and (i) 2×SSC, 0.1% SDS; or (ii) 0.5% BSA, 1 mM EDTA, 40 mM $NaHPO_4$ (pH 7.2), 5% SDS for washing at room temperature. One embodiment of low stringency conditions includes hybridization in 6× sodium chloride/sodium citrate (SSC) at about 45° C., followed by two washes in 0.2×SSC, 0.1% SDS at least at 50° C. (the temperature of the washes can be increased to 55° C. for low stringency conditions). Medium stringency conditions include and encompass from at least about 16% v/v to at least about 30% v/v formamide and from at least about 0.5 M to at least about 0.9 M salt for hybridization at 42° C., and at least about 0.1 M to at least about 0.2 M salt for washing at 55° C. Medium stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at 60-65° C. One embodiment of medium stringency conditions includes hybridizing in 6×SSC at about 45° C., followed by one or more washes in 0.2×SSC, 0.1% SDS at 60° C. High stringency conditions include and encompass from at least about 31% v/v to at least about 50% v/v formamide and from about 0.01 M to about 0.15 M salt for hybridization at 42° C., and about 0.01 M to about 0.02 M salt for washing at 55° C. High stringency conditions also may include 1% BSA, 1 mM EDTA, 0.5 M NaHPO$_4$ (pH 7.2), 7% SDS for hybridization at 65° C., and (i) 0.2×SSC, 0.1% SDS; or (ii) 0.5% BSA, 1 mM EDTA, 40 mM NaHPO$_4$ (pH 7.2), 1% SDS for washing at a temperature in excess of 65° C. One embodiment of high stringency conditions includes hybridizing in 6×SSC at about 45° C., followed by one or more washes in 0.2×SSC, 0.1% SDS at 65° C.

In certain embodiments, an antigen-binding molecule of the invention is encoded by a polynucleotide that hybridizes to a disclosed nucleotide sequence under very high stringency conditions. One embodiment of very high stringency conditions includes hybridizing 0.5 M sodium phosphate, 7% SDS at 65° C., followed by one or more washes at 0.2×SSC, 1% SDS at 65° C.

Other stringency conditions are well known in the art and a skilled addressee will recognize that various factors can be manipulated to optimize the specificity of the hybridization. Optimization of the stringency of the final washes can serve to ensure a high degree of hybridization. For detailed examples, see Ausubel et al., supra at pages 2.10.1 to 2.10.16 and Sambrook et al. (1989, supra) at sections 1.101 to 1.104.

While stringent washes are typically carried out at temperatures from about 42° C. to 68° C., one skilled in the art will appreciate that other temperatures may be suitable for stringent conditions. Maximum hybridization rate typically occurs at about 20° C. to 25° C. below the $T_m$ for formation of a DNA-DNA hybrid. It is well known in the art that the $T_m$ is the melting temperature, or temperature at which two complementary polynucleotide sequences dissociate. Methods for estimating $T_m$ are well known in the art (see Ausubel et al., supra at page 2.10.8). In general, the $T_m$ of a perfectly matched duplex of DNA may be predicted as an approximation by the formula:

$$T_m = 81.5 + 16.6(\log_{10} M) + 0.41(\% \ G+C) - 0.63(\% \ \text{formamide}) - (600/\text{length})$$

wherein: M is the concentration of Na$^+$, preferably in the range of 0.01 molar to 0.4 molar; % G+C is the sum of guanosine and cytosine bases as a percentage of the total number of bases, within the range between 30% and 75% G+C; % formamide is the percent formamide concentration by volume; length is the number of base pairs in the DNA duplex. The $T_m$ of a duplex DNA decreases by approximately 1° C. with every increase of 1% in the number of randomly mismatched base pairs. Washing is generally carried out at $T_m$—15° C. for high stringency, or $T_m$—30° C. for moderate stringency.

In one example of a hybridization procedure, a membrane (e.g., a nitrocellulose membrane or a nylon membrane) containing immobilized DNA is hybridized overnight at 42° C. in a hybridization buffer (50% deionised formamide, 5×SSC, 5×Denhardt's solution (0.1% ficoll, 0.1% polyvinylpyrollidone and 0.1% bovine serum albumin), 0.1% SDS and 200 mg/mL denatured salmon sperm DNA) containing labeled probe. The membrane is then subjected to two sequential medium stringency washes (i.e., 2×SSC, 0.1% SDS for 15 min at 45° C., followed by 2×SSC, 0.1% SDS for 15 min at 50° C.), followed by two sequential higher stringency washes (i.e., 0.2×SSC, 0.1% SDS for 12 min at 55° C. followed by 0.2×SSC and 0.1% SDS solution for 12 min at 65-68° C.

5. Polypeptides of the Invention

The present invention also contemplates full-length polypeptides encoded by the endotoxemia marker genes of the invention as well as the biologically active portions of those polypeptides, which are referred to collectively herein as "endotoxemia marker polypeptides." Biologically active portions of full-length endotoxemia marker polypeptides include portions with immuno-interactive activity of at least about 6, 8, 10, 12, 14, 16, 18, 20, 25, 30, 40, 50, 60 amino acid residues in length. For example, immuno-interactive fragments contemplated by the present invention are at least 6 and desirably at least 8 amino acid residues in length, which can elicit an immune response in an animal for the production of antigen-binding molecules that are immuno-interactive with an endotoxemia marker polypeptide of the invention. Such antigen-binding molecules can be used to screen other mammals, especially equine mammals, for structurally and/or functionally related endotoxemia marker polypeptides. Typically, portions of a full-length endotoxemia marker polypeptide may participate in an interaction, for example, an intramolecular or an inter-molecular interaction. An inter-molecular interaction can be a specific binding interaction or an enzymatic interaction (e.g., the interaction can be transient and a covalent bond is formed or broken). Biologically active portions of a full-length endotoxemia marker polypeptide include peptides comprising amino acid sequences sufficiently similar to or derived from the amino acid sequences of a (putative) full-length endotoxemia marker polypeptide, for example, the amino acid sequences shown in SEQ ID NO: 2, 4, 6, 9, 11, 13, 15, 19, 21, 23, 25, 29, 31, 33, 51, 53 or 58, which include less amino acids than a full-length endotoxemia marker polypeptide, and exhibit at least one activity of that polypeptide. Typically, biologically active portions comprise a domain or motif with at least one activity of a full-length endotoxemia marker polypeptide. A biologically active portion of a full-length endotoxemia marker polypeptide can be a polypeptide which is, for example, 5, 6, 7, 8, 9, 10, 11, 12, 13, 14, 15, 16, 17, 18, 19, 20, 21, 22, 23, 24, 25, 30, 40, 50, 60, 70, 80, 90, 100, 120, 150, 300, 400, 500, 600, 700, 800, 900 or 1000, or even at least about 2000 or 3000, or more amino acid residues in length. Suitably, the portion is a "biologically-active portion" having no less than about 1%, 10%, 25% 50% of the activity of the full-length polypeptide from which it is derived.

The present invention also contemplates variant endotoxemia marker polypeptides. "Variant" polypeptides include proteins derived from the native protein by deletion (socalled truncation) or addition of one or more amino acids to the N-terminal and/or C-terminal end of the native protein; deletion or addition of one or more amino acids at one or more sites in the native protein; or substitution of one or more amino acids at one or more sites in the native protein. Variant proteins encompassed by the present invention are biologically active, that is, they continue to possess the desired biological activity of the native protein. Such variants may result from, for example, genetic polymorphism or from human manipulation. Biologically active variants of a native endotoxemia marker polypeptide of the invention will have at least 40%, 50%, 60%, 70%, generally at least 75%, 80%, 85%, preferably about 90% to 95% or more, and more preferably about 98% or more sequence similarity with the amino acid sequence for the native protein as determined by sequence alignment programs described elsewhere herein using default parameters. A biologically active variant of a protein of the invention may differ from that protein generally by as much 1000, 500, 400, 300, 200, 100, 50 or 20 amino acid residues or suitably by as few as 1-15 amino acid residues, as few as 1-10, such as 6-10, as few as 5, as few as 4, 3, 2, or even 1 amino acid residue.

An endotoxemia marker polypeptide of the invention may be altered in various ways including amino acid substitutions, deletions, truncations, and insertions. Methods for such manipulations are generally known in the art. For example, amino acid sequence variants of an endotoxemia marker protein can be prepared by mutations in the DNA. Methods for mutagenesis and nucleotide sequence alterations are well known in the art. See, for example, Kunkel (1985, *Proc. Natl. Acad. Sci. USA* 82:488-492), Kunkel et al. (1987, *Methods in Enzymol.* 154:367-382), U.S. Pat. No. 4,873,192, Watson, J. D. et al. ("Molecular Biology of the Gene", Fourth Edition, Benjamin/Cummings, Menlo Park, Calif., 1987) and the references cited therein. Guidance as to appropriate amino acid substitutions that do not affect biological activity of the protein of interest may be found in the model of Dayhoff et al. (1978) Atlas of Protein Sequence and Structure (Natl. Biomed. Res. Found., Washington, D.C.). Methods for screening gene products of combinatorial libraries made by point mutations or truncation, and for screening cDNA libraries for gene products having a selected property are known in the art. Such methods are adaptable for rapid screening of the gene libraries generated by combinatorial mutagenesis of endotoxemia marker polypeptides. Recursive ensemble mutagenesis (REM), a technique which enhances the frequency of functional mutants in the libraries, can be used in combination with the screening assays to identify endotoxemia marker polypeptide variants (Arkin and Yourvan (1992) *Proc. Natl. Acad. Sci. USA* 89:7811-7815; Delgrave et al. (1993) *Protein Engineering* 6:327-331). Conservative substitutions, such as exchanging one amino acid with another having similar properties, may be desirable as discussed in more detail below.

Variant endotoxemia marker polypeptides may contain conservative amino acid substitutions at various locations along their sequence, as compared to the parent endotoxemia marker amino acid sequence. A "conservative amino acid substitution" is one in which the amino acid residue is replaced with an amino acid residue having a similar side chain. Families of amino acid residues having similar side chains have been defined in the art, which can be generally sub-classified as follows:

Acidic: The residue has a negative charge due to loss of H ion at physiological pH and the residue is attracted by aqueous solution so as to seek the surface positions in the conformation of a peptide in which it is contained when the peptide is in aqueous medium at physiological pH. Amino acids having an acidic side chain include glutamic acid and aspartic acid.

Basic: The residue has a positive charge due to association with H ion at physiological pH or within one or two pH units thereof (e.g., histidine) and the residue is attracted by aqueous solution so as to seek the surface positions in the conformation of a peptide in which it is contained when the peptide is in aqueous medium at physiological pH. Amino acids having a basic side chain include arginine, lysine and histidine.

Charged: The residues are charged at physiological pH and, therefore, include amino acids having acidic or basic side chains (i.e., glutamic acid, aspartic acid, arginine, lysine and histidine).

Hydrophobic: The residues are not charged at physiological pH and the residue is repelled by aqueous solution so as to seek the inner positions in the conformation of a peptide in which it is contained when the peptide is in aqueous medium. Amino acids having a hydrophobic side chain include tyrosine, valine, isoleucine, leucine, methionine, phenylalanine and tryptophan.

Neutral/polar: The residues are not charged at physiological pH, but the residue is not sufficiently repelled by aqueous solutions so that it would seek inner positions in the conformation of a peptide in which it is contained when the peptide is in aqueous medium. Amino acids having a neutral/polar side chain include asparagine, glutamine, cysteine, histidine, serine and threonine.

This description also characterizes certain amino acids as "small" since their side chains are not sufficiently large, even if polar groups are lacking, to confer hydrophobicity. With the exception of proline, "small" amino acids are those with four carbons or less when at least one polar group is on the side chain and three carbons or less when not. Amino acids having a small side chain include glycine, serine, alanine and threonine. The gene-encoded secondary amino acid proline is a special case due to its known effects on the secondary conformation of peptide chains. The structure of proline differs from all the other naturally-occurring amino acids in that its side chain is bonded to the nitrogen of the α-amino group, as well as the α-carbon. Several amino acid similarity matrices (e.g., PAM120 matrix and PAM250 matrix as disclosed for example by Dayhoff et al. (1978) A model of evolutionary change in proteins. Matrices for determining distance relationships In M. O. Dayhoff, (ed.), Atlas of protein sequence and structure, Vol. 5, pp. 345-358, National Biomedical Research Foundation, Washington D.C.; and by Gonnet et al., 1992, *Science* 256(5062): 144301445), however, include proline in the same group as glycine, serine, alanine and threonine. Accordingly, for the purposes of the present invention, proline is classified as a "small" amino acid.

The degree of attraction or repulsion required for classification as polar or nonpolar is arbitrary and, therefore, amino acids specifically contemplated by the invention have been classified as one or the other. Most amino acids not specifically named can be classified on the basis of known behavior.

Amino acid residues can be further sub-classified as cyclic or noncyclic, and aromatic or nonaromatic, self-explanatory classifications with respect to the side-chain substituent groups of the residues, and as small or large. The residue is considered small if it contains a total of four carbon atoms or less, inclusive of the carboxylcarbon, provided an additional polar substituent is present; three or less if not. Small residues are, of course, always nonaromatic. Dependent on their structural properties, amino acid residues may fall in two or more classes. For the naturally-occurring protein amino acids, sub-classification according to the this scheme is presented in the Table 3.

Conservative amino acid substitution also includes groupings based on side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. For example, it is reasonable to expect that replacement of a leucine with an isoleucine or valine, an aspartate with a glutamate, a threonine with a serine, or a similar replacement of an amino acid with a structurally related amino acid will not have a major effect on the properties of the resulting variant polypeptide. Whether an amino acid change results in a functional endotoxemia marker polypeptide can readily be determined by assaying its activity. Conservative substitutions are shown in Table 4 below under the heading of exemplary substitutions. More preferred substitutions are shown under the heading of preferred substitutions. Amino acid substitutions falling within the scope of the invention, are, in general, accomplished by selecting substitutions that do not differ significantly in their effect on maintaining (a) the structure of the peptide backbone in the area of the substitution, (b) the charge or hydrophobicity of the molecule at the target site, or (c) the bulk of the side chain. After the substitutions are introduced, the variants are screened for biological activity.

Alternatively, similar amino acids for making conservative substitutions can be grouped into three categories based on the identity of the side chains. The first group includes glutamic acid, aspartic acid, arginine, lysine, histidine, which all have charged side chains; the second group includes glycine, serine, threonine, cysteine, tyrosine, glutamine, asparagine; and the third group includes leucine, isoleucine, valine, alanine, proline, phenylalanine, tryptophan, methionine, as described in Zubay, G., *Biochemistry*, third edition, Wm.C. Brown Publishers (1993).

Thus, a predicted non-essential amino acid residue in an endotoxemia marker polypeptide is typically replaced with another amino acid residue from the same side chain family. Alternatively, mutations can be introduced randomly along all or part of an endotoxemia marker gene coding sequence, such as by saturation mutagenesis, and the resultant mutants can be screened for an activity of the parent polypeptide to identify mutants which retain that activity. Following mutagenesis of the coding sequences, the encoded peptide can be expressed recombinantly and the activity of the peptide can be determined.

Accordingly, the present invention also contemplates variants of the naturally-occurring endotoxemia marker polypeptide sequences or their biologically-active fragments, wherein the variants are distinguished from the naturally-occurring sequence by the addition, deletion, or substitution of one or more amino acid residues. In general, variants will display at least about 30, 40, 50, 55, 60, 65, 70, 75, 80, 85, 90, 91, 92, 93, 94, 95, 96, 97, 98, 99% similarity to a parent endotoxemia marker polypeptide sequence as, for example, set forth in any one of SEQ ID NO: 2, 4, 6, 9, 11, 13, 15, 19, 21, 23, 25, 29, 31, 33, 51, 53 or 58. Desirably, variants will have at least 30, 40, 50, 55, 60, 65, 70, 75, 80, 85, 90, 91, 92, 93, 94, 95, 96, 97, 98, 99% sequence identity to a parent endotoxemia marker polypeptide sequence as, for example, set forth in any one of SEQ ID NO: 2, 4, 6, 9, 11, 13, 15, 19, 21, 23, 25, 29, 31, 33, 51, 53 or 58. Moreover, sequences differing from the native or parent sequences by the addition, deletion, or substitution of 1, 2, 3, 4, 5, 6, 7, 8, 9, 10, 11, 12, 13, 14, 15, 16, 17, 18, 19, 20, 30, 40, 50, 60, 70, 80, 90, 100, 150, 200, 300, 500 or more amino acids but which retain the properties of the parent endotoxemia marker polypeptide are contemplated. endotoxemia marker polypeptides also include polypeptides that are encoded by polynucleotides that hybridize under stringency conditions as defined herein, especially high stringency conditions, to the endotoxemia marker polynucleotide sequences of the invention, or the non-coding strand thereof, as described above.

In one embodiment, variant polypeptides differ from an endotoxemia marker sequence by at least one but by less than 50, 40, 30, 20, 15, 10, 8, 6, 5, 4, 3 or 2 amino acid residue(s). In another, variant polypeptides differ from the corresponding sequence in any one of SEQ ID NO: 2, 4, 6, 9, 11, 13, 15, 19, 21, 23, 25, 29, 31, 33, 51, 53 or 58 by at least 1% but less than 20%, 15%, 10% or 5% of the residues. (If this comparison requires alignment the sequences should be aligned for maximum similarity. "Looped" out sequences from deletions or insertions, or mismatches, are considered differences.) The differences are, suitably, differences or changes at a non-essential residue or a conservative substitution.

A "non-essential" amino acid residue is a residue that can be altered from the wild-type sequence of an embodiment polypeptide without abolishing or substantially altering one or more of its activities. Suitably, the alteration does not substantially alter one of these activities, for example, the activity is at least 20%, 40%, 60%, 70% or 80% of wild-type. An "essential" amino acid residue is a residue that, when altered from the wild-type sequence of an endotoxemia marker polypeptide of the invention, results in abolition of an activity of the parent molecule such that less than 20% of the wild-type activity is present.

In other embodiments, a variant polypeptide includes an amino acid sequence having at least about 50%, 55%, 60%, 65%, 70%, 75%, 80%, 85%, 90%, 91%, 92%, 93%, 94% 95%, 96%, 97%, 98% or more similarity to a corresponding sequence of an endotoxemia marker polypeptide as, for example, set forth in any one of SEQ JD NO: 2, 4, 6, 9, 11, 13, 15, 19, 21, 23, 25, 29, 31, 33, 51, 53 or 58, and has the activity of that endotoxemia marker polypeptide.

Endotoxemia marker polypeptides of the invention may be prepared by any suitable procedure known to those of skill in the art. For example, the polypeptides may be prepared by a procedure including the steps of (a) preparing a chimeric construct comprising a nucleotide sequence that encodes at least a portion of an endotoxemia marker polynucleotide and that is operably linked to a regulatory element; (b) introducing the chimeric construct into a host cell; (c) culturing the host cell to express the endotoxemia marker polypeptide; and (d) isolating the endotoxemia marker polypeptide from the host cell. In illustrative examples, the nucleotide sequence encodes at least a portion of the sequence set forth in any one of SEQ ID NO: 2, 4, 6, 9, 11, 13, 15, 19, 21, 23, 25, 29, 31, 33, 51, 53 or 58 or a variant thereof.

The chimeric construct is typically in the form of an expression vector, which is suitably selected from self-replicating extra-chromosomal vectors (e.g., plasmids) and vectors that integrate into a host genome.

The regulatory element will generally be appropriate for the host cell employed for expression of the endotoxemia marker polynucleotide. Numerous types of expression vectors and regulatory elements are known in the art for a variety of host cells. Illustrative elements of this type include, but are not restricted to, promoter sequences (e.g., constitutive or inducible promoters which may be naturally occurring or combine elements of more than one promoter), leader or signal sequences, ribosomal binding sites, transcriptional start and stop sequences, translational start and termination sequences, and enhancer or activator sequences.

In some embodiments, the expression vector comprises a selectable marker gene to permit the selection of transformed host cells. Selectable marker genes are well known in the art and will vary with the host cell employed.

The expression vector may also include a fusion partner (typically provided by the expression vector) so that the endotoxemia marker polypeptide is produced as a fusion polypeptide with the fusion partner. The main advantage of fusion partners is that they assist identification and/or purification of the fusion polypeptide. In order to produce the fusion polypeptide, it is necessary to ligate the endotoxemia marker polynucleotide into an expression vector so that the translational reading frames of the fusion partner and the endotoxemia marker polynucleotide coincide. Well known examples of fusion partners include, but are not limited to, glutathione-S-transferase (GST), Fc potion of human IgG, maltose binding protein (MBP) and hexahistidine ($HIS_6$), which are particularly useful for isolation of the fusion polypeptide by affinity chromatography. In some embodiments, fusion polypeptides are purified by affinity chromatography using matrices to which the fusion partners bind such as but not limited to glutathione-, amylose-, and nickel- or cobalt-conjugated resins. Many such matrices are available in "kit" form, such as the QIAexpress™ system (Qiagen) useful with ($HIS_6$) fusion partners and the Pharmacia GST purification system. Other fusion partners known in the art are light-emitting proteins such as green fluorescent protein (GFP) and luciferase, which serve as fluorescent "tags" that permit the identification and/or isolation of fusion polypeptides by fluorescence microscopy or by flow cytometry. Flow cytometric methods such as fluorescence activated cell sorting (FACS) are particularly useful in this latter application.

Desirably, the fusion partners also possess protease cleavage sites, such as for Factor $X_a$ or Thrombin, which permit the relevant protease to partially digest the fusion polypeptide and thereby liberate the endotoxemia marker polypeptide from the fusion construct. The liberated polypeptide can then be isolated from the fusion partner by subsequent chromatographic separation.

Fusion partners also include within their scope "epitope tags," which are usually short peptide sequences for which a specific antibody is available. Well known examples of epitope tags for which specific monoclonal antibodies are readily available include c-Myc, influenza virus, hemagglutinin and FLAG tags.

The chimeric constructs of the invention are introduced into a host by any suitable means including "transduction" and "transfection", which are art recognized as meaning the introduction of a nucleic acid, for example, an expression vector, into a recipient cell by nucleic acid-mediated gene transfer. "Transformation," however, refers to a process in which a host's genotype is changed as a result of the cellular uptake of exogenous DNA or RNA and, for example, the transformed cell comprises the expression system of the invention. There are many methods for introducing chimeric constructs into cells. Typically, the method employed will depend on the choice of host cell. Technology for introduction of chimeric constructs into host cells is well known to those of skill in the art. Four general classes of methods for delivering nucleic acid molecules into cells have been described: (1) chemical methods such as calcium phosphate precipitation, polyethylene glycol (PEG)-mediate precipitation and lipofection; (2) physical methods such as microinjection, electroporation, acceleration methods and vacuum infiltration; (3) vector based methods such as bacterial and viral vector-mediated transformation; and (4) receptor-mediated. Transformation techniques that fall within these and other classes are well known to workers in the art, and new techniques are continually becoming known. The particular choice of a transformation technology will be determined by its efficiency to transform certain host species as well as the experience and preference of the person practicing the invention with a particular methodology of choice. It will be apparent to the skilled person that the particular choice of a transformation system to introduce a chimeric construct into cells is not essential to or a limitation of the invention, provided it achieves an acceptable level of nucleic acid transfer.

Recombinant endotoxemia marker polypeptides may be produced by culturing a host cell transformed with a chimeric construct. The conditions appropriate for expression of the endotoxemia marker polynucleotide will vary with the choice of expression vector and the host cell and are easily ascertained by one skilled in the art through routine experimentation. Suitable host cells for expression may be prokaryotic or eukaryotic. An illustrative host cell for expression of a polypeptide of the invention is a bacterium. The bacterium used may be *Escherichia coli*. Alternatively, the host cell may be a yeast cell or an insect cell such as, for example, SF9 cells that may be utilized with a baculovirus expression system.

Recombinant endotoxemia marker polypeptides can be conveniently prepared using standard protocols as described for example in Sambrook, et al., (1989, supra), in particular Sections 16 and 17; Ausubel et al., (1994, supra), in particular Chapters 10 and 16; and Coligan et al., CURRENT PROTOCOLS IN PROTEIN SCIENCE (John Wiley & Sons, Inc. 1995-1997), in particular Chapters 1, 5 and 6. Alternatively, the endotoxemia marker polypeptides may be synthesized by chemical synthesis, e.g., using solution synthesis or solid phase synthesis as described, for example, in Chapter 9 of Atherton and Shephard (supra) and in Roberge et al (1995, *Science* 269: 202).

6. Antigen-Binding Molecules

The invention also provides antigen-binding molecules that are specifically immuno-interactive with an endotoxemia marker polypeptide of the invention. In one embodiment, the antigen-binding molecule comprise whole polyclonal antibodies. Such antibodies may be prepared, for example, by injecting an endotoxemia marker polypeptide of the invention into a production species, which may include mice or rabbits, to obtain polyclonal antisera. Methods of producing polyclonal antibodies are well known to those skilled in the art. Exemplary protocols which may be used are described for example in Coligan et al., CURRENT PROTOCOLS IN IMMUNOLOGY, (John Wiley & Sons, Inc, 1991), and Ausubel et al., (1994-1998, supra), in particular Section III of Chapter 11.

In lieu of polyclonal antisera obtained in a production species, monoclonal antibodies may be produced using the standard method as described, for example, by Köhler and Milstein (1975, *Nature* 256, 495-497), or by more recent modifications thereof as described, for example, in Coligan et al., (1991, supra) by immortalizing spleen or other antibody producing cells derived from a production species which has been inoculated with one or more of the endotoxemia marker polypeptides of the invention.

The invention also contemplates as antigen-binding molecules Fv, Fab, Fab' and F(ab')$_2$ immunoglobulin fragments. Alternatively, the antigen-binding molecule may comprise a synthetic stabilized Fv fragment. Exemplary fragments of this type include single chain Fv fragments (sFv, frequently termed scFv) in which a peptide linker is used to bridge the N terminus or C terminus of a $V_H$ domain with the C terminus or N-terminus, respectively, of a $V_L$ domain. ScFv lack all constant parts of whole antibodies and are not able to activate complement. ScFvs may be prepared, for example, in accordance with methods outlined in Kreber et al (Kreber et al. 1997, *J. Immunol. Methods;* 201(1): 35-55). Alternatively, they may be prepared by methods described in U.S. Pat. No. 5,091,513, European Patent No 239,400 or the articles by Winter and Milstein (1991, *Nature* 349:293) and Plückthun et al (1996, In *Antibody engineering: A practical approach.* 203-252). In another embodiment, the synthetic stabilized Fv fragment comprises a disulfide stabilized Fv (dsFv) in which cysteine residues are introduced into the $V_H$ and $V_L$ domains such that in the fully folded Fv molecule the two residues will form a disulfide bond between them. Suitable methods of producing dsFv are described for example in (Glockscuther et al. *Biochem.* 29: 1363-1367; Reiter et al. 1994, *J. Biol. Chem.* 269: 18327-18331; Reiter et al. 1994, *Biochem.* 33: 5451-5459; Reiter et al. 1994. *Cancer Res.* 54: 2714-2718; Webber et al. 1995, *Mol. Immunol.* 32: 249-258).

Phage display and combinatorial methods for generating anti-endotoxemia marker polypeptide antigen-binding molecules are known in the art (as described in, e.g., Ladner et al, U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) *Bio/Technology* 9:1370-1372; Hay et al. (1992) *Hum Antibod Hybridomas* 3:81-85; Huse et al. (1989) *Science* 246:1275-1281; Griffths et al. (1993) *EMBO J* 12:725-734; Hawkins et al. (1992) *J Mol Biol* 226:889-896; Clackson et al. (1991) *Nature* 352:624-628; Gram et al. (1992) *PNAS* 89:3576-3580; Garrad et al. (1991) *Bio/Technology* 9:1373-1377; Hoogenboom et al. (1991) *Nuc Acid Res* 19:4133-4137; and Barbas et al. (1991) *PNAS* 88:7978-7982). The antigen-binding molecules can be used to screen expression libraries for variant endotoxemia marker polypeptides. They can also be used to detect and/or isolate the endotoxemia marker polypeptides of the invention. Thus, the invention also contemplates the use of antigen-binding molecules to isolate endotoxemia marker polypeptides using, for example, any suitable immunoaffinity based method including, but not limited to, immunochromatography and immunoprecipitation. A suitable method utilises solid phase adsorption in which anti-endotoxemia marker polypeptide antigen-binding molecules are attached to a suitable resin, the resin is contacted with a sample suspected of containing an endotoxemia marker polypeptide, and the endotoxemia marker polypeptide, if any, is subsequently eluted from the resin. Illustrative resins include: Sepharose® (Pharmacia), Poros® resins (Roche Molecular Biochemicals, Indianapolis), Actigel Superflow™ resins (Sterogene Bioseparations Inc., Carlsbad Calif.), and Dynabeads™ (Dynal Inc., Lake Success, N.Y.).

The antigen-binding molecule can be coupled to a compound, e.g., a label such as a radioactive nucleus, or imaging agent, e.g. a radioactive, enzymatic, or other, e.g., imaging agent, e.g., a NMR contrast agent. Labels which produce detectable radioactive emissions or fluorescence are preferred. An anti-endotoxemia marker polypeptide antigen-binding molecule (e.g., monoclonal antibody) can be used to detect endotoxemia marker polypeptides (e.g., in a cellular lysate or cell supernatant) in order to evaluate the abundance and pattern of expression of the protein. In certain advantageous application in accordance with the present invention, such antigen-binding molecules can be used to monitor endotoxemia marker polypeptides levels in biological samples (including whole cells and fluids) for diagnosing the presence, absence, degree, or stage of development of endotoxemia. Detection can be facilitated by coupling (i.e., physically linking) the antibody to a detectable substance (i.e., antibody labeling). Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H. The label may be selected from a group including a chromogen, a catalyst, an enzyme, a fluorophore, a chemiluminescent molecule, a lanthanide ion such as Europium (Eu$^{34}$), a radioisotope and a direct visual label. In the case of a direct visual label, use may be made of a colloidal metallic or non-metallic particle, a dye particle, an enzyme or a substrate, an organic polymer, a latex particle, a liposome, or other vesicle containing a signal producing substance and the like.

A large number of enzymes useful as labels is disclosed in United States Patent Specifications U.S. Pat. No. 4,366,241, U.S. Pat. No. 4,843,000, and U.S. Pat. No. 4,849,338. Enzyme labels useful in the present invention include alkaline phosphatase, horseradish peroxidase, luciferase, β-galactosidase, glucose oxidase, lysozyme, malate dehydrogenase and the like. The enzyme label may be used alone or in combination with a second enzyme in solution.

7. Methods of Detecting Aberrant Endotoxemia Marker Gene Expression or the Presence of Endotoxemia Marker Polynucleotides The present invention is predicated in part on the discovery that: horses with clinical evidence of endotoxemia-related conditions have aberrant expression of certain genes (referred to herein as "endotoxemia marker genes") whose transcripts include, but are not limited to, SEQ ID NO: 1, 3, 4, 5, 6, 7, 9, 10, 11, 13, 15, 16, 17, 18, 19, 21, 23, 25, 26, 27, 29, 31, 33, 35, 37, 38, 39, 41, 42, 43, 44, 45, 47, 49, 50, 52, 54, 56, 58, 60, 61, 63, 64, 66, 67, 68, 69, 70, 71, 73, 75, 76, 77, 78, 79, 80, 81, 82, 83, 84, 86, 88, 90, 92, 93, 94, 96, 98, 100, 101, 102, 103, 104, 106, 107, 109, 110, 111, 113, 114, 115, 117, 119, 121, 122, 123, 124, 125, 126, 128, 130, 132, 134, 136, 137, 139, 141, 143, 145, 147, 149, 151, 153, 155, 157, 158, 160, 162, 164, 166, 168, 169, 170, 172, 173, 174, 176, 178, 180, 182, 184, 186, 188, 190, 192, 193, 194, 195, 197, 199, 201, 203, 205, 206, 207, 209, 210, 211, 212, 214, 215, 216, 218, 220, 222, 223, 224, 225, 227, 229, 231, 233, 235, 236, 237, 239, 240, 242, 244, 245, 246, 248, 250, 252, 254, 255, 257, 259 260, 262, 264, 266, 268, 269, 270, 271, 272, 274, 276, 278, 279, 280, 282, 284, 286, 288, 290, 292, 294, 296, 298, 300, 302, 304, 305, 306, 307, 309, 311, 312, 314, 315, 316, 318, 320 321, 323 or 325, as compared to normal horses or to horses lacking endotoxemia-related conditions.

Accordingly, in certain embodiments, the invention features a method for diagnosing the presence, absence, degree or stage of an endotoxemia-related condition in a subject, which is typically of equine origin, by detecting aberrant expression of an endotoxemia marker gene in a biological sample obtained from the subject. Accordingly, in order to make such diagnoses, it will be desirable to qualitatively or quantitatively determine the levels of endotoxemia marker gene transcripts or the level or functional activity of endotoxemia marker polypeptides. In some embodiments, the presence, degree, or stage of development of an endotoxemia-related condition is diagnosed when an endotoxemia marker gene product is expressed at a detectably lower level in the biological sample as compared to the level at which that gene is expressed in a reference sample obtained from normal subjects or from subjects lacking that condition. In other embodiments, the presence, degree, or stage of development of an endotoxemia-related condition is diagnosed when an endotoxemia marker gene product is expressed at a detectably higher level in the biological sample as compared to the level at which that gene is expressed in a reference sample obtained from normal subjects or from subjects lacking that condition. Generally, such diagnoses are made when the level or functional activity of an endotoxemia marker gene product in the biological sample varies from the level or functional activity of a corresponding endotoxemia marker gene product in the reference sample by at least 10%, 20%, 30%, 40%, 50%, 60%, 70%, 80%, 90%, 92%, 94%, 96%, 97%, 98% or 99%, or even by at least about 99.5%, 99.9%, 99.95%, 99.99%, 99.995% or 99.999%, or even by at least about 100%, 200%, 300%, 400%, 500%, 600%, 700%, 800%, 900% or 1000%. The corresponding gene product is generally selected from the same gene product that is present in the biological sample, a gene product expressed from a variant gene (e.g., an homologous or orthologous gene) including an allelic variant, or a splice variant or protein product thereof. In some embodiments, the method comprises measuring the level or functional activity of individual expression products of at least about 2, 3, 4, 5, 6, 7, 8, 9, 10, 11, 12, 13, 14, 15, 16, 17, 18, 19, 20, 21, 22, 23, 24, 25, 26, 27, 28 29 or 30 endotoxemia marker genes.

Generally, the biological sample contains blood, especially peripheral blood, or a fraction or extract thereof. Typically, the biological sample comprises blood cells such as mature, immature and developing leukocytes, including lymphocytes, polymorphonuclear leukocytes, neutrophils, monocytes, reticulocytes, basophils, coelomocytes, hemocytes, eosinophils, megakaryocytes, macrophages, dendritic cells natural killer cells, or fraction of such cells (e.g., a nucleic acid or protein fraction). In specific embodiments, the biological sample comprises leukocytes including peripheral blood mononuclear cells (PBMC).

7.1 Nucleic Acid-Based Diagnostics

Nucleic acid used in polynucleotide-based assays can be isolated from cells contained in the biological sample, according to standard methodologies (Sambrook, et al., 1989, supra; and Ausubel et al., 1994, supra). The nucleic acid is typically fractionated (e.g., poly A$^+$RNA) or whole cell RNA. Where RNA is used as the subject of detection, it may be desired to convert the RNA to a complementary DNA. In some embodiments, the nucleic acid is amplified by a template-dependent nucleic acid amplification technique. A number of template dependent processes are available to amplify the endotoxemia marker sequences present in a given template sample. An exemplary nucleic acid amplification technique is the polymerase chain reaction (referred to as PCR) which is described in detail in U.S. Pat. Nos. 4,683,195, 4,683,202 and 4,800,159, Ausubel et al. (supra), and in Innis et al., ("PCR Protocols", Academic Press, Inc., San Diego Calif., 1990). Briefly, in PCR, two primer sequences are prepared that are complementary to regions on opposite complementary strands of the marker sequence. An excess of deoxynucleoside triphosphates are added to a reaction mixture along with a DNA polymerase, e.g., Taq polymerase. If a cognate endotoxemia marker sequence is present in a sample, the primers will bind to the marker and the polymerase will cause the primers to be extended along the marker sequence by adding on nucleotides. By raising and lowering the temperature of the reaction mixture, the extended primers will dissociate from the marker to form reaction products, excess primers will bind to the marker and to the reaction products and the process is repeated. A reverse transcriptase PCR amplification procedure may be performed in order to quantify the amount of mRNA amplified. Methods of reverse transcribing RNA into cDNA are well known and described in Sambrook et al., 1989, supra. Alternative methods for reverse transcription utilize thermostable, RNA-dependent DNA polymerases. These methods are described in WO 90/07641. Polymerase chain reaction methodologies are well known in the art.

In certain advantageous embodiments, the template-dependent amplification involves the quantification of transcripts in real-time. For example, RNA or DNA may be quantified using the Real-Time PCR technique (Higuchi, 1992, et al., Biotechnology 10: 413-417). By determining the concentration of the amplified products of the target DNA in PCR reactions that have completed the same number of cycles and are in their linear ranges, it is possible to determine the relative concentrations of the specific target sequence in the original DNA mixture. If the DNA mixtures are cDNAs synthesized from RNAs isolated from different tissues or cells, the relative abundance of the specific mRNA from which the target sequence was derived can be determined for the respective tissues or cells. This direct proportionality between the concentration of the PCR products and the relative mRNA abundance is only true in the linear range of the PCR reaction. The final concentration of the target DNA in the plateau portion of the curve is determined by the availability of reagents in the reaction mix and is independent of the original concentration of target DNA.

Another method for amplification is the ligase chain reaction ("LCR"), disclosed in EPO No. 320 308. In LCR, two complementary probe pairs are prepared, and in the presence of the target sequence, each pair will bind to opposite complementary strands of the target such that they abut. In the presence of a ligase, the two probe pairs will link to form a single unit. By temperature cycling, as in PCR, bound ligated units dissociate from the target and then serve as "target sequences" for ligation of excess probe pairs. U.S. Pat. No. 4,883,750 describes a method similar to LCR for binding probe pairs to a target sequence.

Qβ Replicase, described in PCT Application No. PCT/US87/00880, may also be used. In this method, a replicative sequence of RNA that has a region complementary to that of a target is added to a sample in the presence of an RNA polymerase. The polymerase will copy the replicative sequence that can then be detected.

An isothermal amplification method, in which restriction endonucleases and ligases are used to achieve the amplification of target molecules that contain nucleotide 5'α-thiotriphosphates in one strand of a restriction site may also be useful in the amplification of nucleic acids in the present invention, Walker et al., (1992, *Proc. Natl. Acad. Sci. U.S.A.* 89: 392-396).

Strand Displacement Amplification (SDA) is another method of carrying out isothermal amplification of nucleic acids which involves multiple rounds of strand displacement and synthesis, i.e., nick translation. A similar method, called Repair Chain Reaction (RCR), involves annealing several probes throughout a region targeted for amplification, followed by a repair reaction in which only two of the four bases are present. The other two bases can be added as biotinylated derivatives for easy detection. A similar approach is used in SDA. Target specific sequences can also be detected using a cyclic probe reaction (CPR). In CPR, a probe having 3' and 5' sequences of non-specific DNA and a middle sequence of specific RNA is hybridized to DNA that is present in a sample. Upon hybridization, the reaction is treated with RNase H, and the products of the probe identified as distinctive products that are released after digestion. The original template is annealed to another cycling probe and the reaction is repeated.

Still another amplification method described in GB Application No. 2 202 328, and in PCT Application No. PCT/US89/01025, may be used. In the former application, "modified" primers are used in a PCR-like, template- and enzyme-dependent synthesis. The primers may be modified by labeling with a capture moiety (e.g., biotin) and/or a detector moiety (e.g., enzyme). In the latter application, an excess of labeled probes are added to a sample. In the presence of the target sequence, the probe binds and is cleaved catalytically. After cleavage, the target sequence is released intact to be bound by excess probe. Cleavage of the labelled probe signals the presence of the target sequence.

Other nucleic acid amplification procedures include transcription-based amplification systems (TAS), including nucleic acid sequence based amplification (NASBA) and 3SR (Kwoh et al., 1989, *Proc. Natl. Acad. Sci. USA.,* 86: 1173; Gingeras et al., PCT Application WO 88/10315). In NASBA, the nucleic acids can be prepared for amplification by standard phenol/chloroform extraction, heat denaturation of a clinical sample, treatment with lysis buffer and minispin columns for isolation of DNA and RNA or guanidinium chloride extraction of RNA. These amplification techniques involve annealing a primer which has target specific sequences. Following polymerization, DNA/RNA hybrids are digested with RNase H while double stranded DNA molecules are heat denatured again. In either case the single stranded DNA is made fully double stranded by addition of second target specific primer, followed by polymerisation. The double-stranded DNA molecules are then multiply transcribed by an RNA polymerase such as T7 or SP6. In an isothermal cyclic reaction, the RNAs are reverse transcribed into single stranded DNA, which is then converted to double stranded DNA, and then transcribed once again with an RNA polymerase such as T7 or SP6. The resulting products, whether truncated or complete, indicate target specific sequences.

Vincent and Kong disclose a method termed helicase-dependent isothermal DNA amplification (HDA) (Vincent and Kong, EMBO Reports, 5(8):795-800, 2004). This method uses DNA helicase to separate DNA strands and hence does not require thermal cycling. The entire reaction can be carried out at one temperature and this method should have broad application to point-of-care DNA diagnostics.

Davey et al., EPO No. 329 822 disclose a nucleic acid amplification process involving cyclically synthesizing single-stranded RNA ("ssRNA"), ssDNA, and double-stranded DNA (dsDNA), which may be used in accordance with the present invention. The ssRNA is a template for a first primer oligonucleotide, which is elongated by reverse transcriptase (RNA-dependent DNA polymerase). The RNA is then removed from the resulting DNA:RNA duplex by the action of ribonuclease H(RNase H, an RNase specific for RNA in duplex with either DNA or RNA). The resultant ssDNA is a template for a second primer, which also includes the sequences of an RNA polymerase promoter (exemplified by T7 RNA polymerase) 5' to its homology to the template. This primer is then extended by DNA polymerase (exemplified by the large "Klenow" fragment of *E. coli* DNA polymerase I), resulting in a double-stranded DNA ("dsDNA") molecule, having a sequence identical to that of the original RNA between the primers and having additionally, at one end, a promoter sequence. This promoter sequence can be used by the appropriate RNA polymerase to make many RNA copies of the DNA. These copies can then re-enter the cycle leading to very swift amplification. With proper choice of enzymes, this amplification can be done isothermally without addition of enzymes at each cycle. Because of the cyclical nature of this process, the starting sequence can be chosen to be in the form of either DNA or RNA.

Miller et al. in PCT Application WO 89/06700 disclose a nucleic acid sequence amplification scheme based on the hybridization of a promoter/primer sequence to a target single-stranded DNA ("ssDNA") followed by transcription of many RNA copies of the sequence. This scheme is not cyclic, i.e., new templates are not produced from the resultant RNA transcripts. Other amplification methods include "RACE" and "one-sided PCR" (Frohman, M. A., In: "PCR Protocols: A Guide to Methods and Applications", Academic Press, N.Y., 1990; Ohara et al., 1989, *Proc. Natl Acad. Sci. U.S.A.,* 86: 5673-567).

Methods based on ligation of two (or more) oligonucleotides in the presence of nucleic acid having the sequence of the resulting "di-oligonucleotide", thereby amplifying the di-oligonucleotide, may also be used for amplifying target nucleic acid sequences. Wu et al., (1989, *Genomics* 4: 560).

Depending on the format, the endotoxemia marker nucleic acid of interest is identified in the sample directly using a template-dependent amplification as described, for example, above, or with a second, known nucleic acid following amplification. Next, the identified product is detected. In certain applications, the detection may be performed by visual means (e.g., ethidium bromide staining of a gel). Alternatively, the detection may involve indirect identification of the product via chemiluminescence, radioactive scintigraphy of radiolabel or fluorescent label or even via a system using electrical or thermal impulse signals (Affymax Technology; Bellus, 1994, *J Macromol. Sci. Pure, Appl. Chem.,* A31(1): 1355-1376).

In some embodiments, amplification products or "amplicons" are visualized in order to confirm amplification of the endotoxemia marker sequences. One typical visualization method involves staining of a gel with ethidium bromide and visualization under UV light. Alternatively, if the amplification products are integrally labeled with radio- or fluorometrically-labelled nucleotides, the amplification products can then be exposed to x-ray film or visualized under the appropriate stimulating spectra, following separation. In some embodiments, visualization is achieved indirectly. Following separation of amplification products, a labeled nucleic acid probe is brought into contact with the amplified endotoxemia marker sequence. The probe is suitably conjugated to a chromophore but may be radiolabeled. Alternatively, the probe is conjugated to a binding partner, such as an antigen-binding molecule, or biotin, and the other member of the binding pair carries a detectable moiety or reporter molecule. The techniques involved are well known to those of skill in the art and can be found in many standard texts on molecular protocols (e.g., see Sambrook et al., 1989, supra and Ausubel et al. 1994, supra). For example, chromophore or radiolabel probes or primers identify the target during or following amplification.

In certain embodiments, target nucleic acids are quantified using blotting techniques, which are well known to those of skill in the art. Southern blotting involves the use of DNA as a target, whereas Northern blotting involves the use of RNA as a target. Each provide different types of information, although cDNA blotting is analogous, in many aspects, to blotting or RNA species. Briefly, a probe is used to target a DNA or RNA species that has been immobilized on a suitable matrix, often a filter of nitrocellulose. The different species should be spatially separated to facilitate analysis. This often is accomplished by gel electrophoresis of nucleic acid species followed by "blotting" on to the filter. Subsequently, the blotted target is incubated with a probe (usually labeled) under conditions that promote denaturation and rehybridisation. Because the probe is designed to base pair with the target, the probe will bind a portion of the target sequence under renaturing conditions. Unbound probe is then removed, and detection is accomplished as described above.

Following detection/quantification, one may compare the results seen in a given subject with a control reaction or a statistically significant reference group of normal subjects or of subjects lacking an endotoxemia-related condition. In this way, it is possible to correlate the amount of a endotoxemia marker nucleic acid detected with the progression or severity of the disease.

Also contemplated are genotyping methods and allelic discrimination methods and technologies such as those described by Kristensen et al. (Biotechniques 30(2): 318-322), including the use of single nucleotide polymorphism analysis, high performance liquid chromatography, TaqMan®, liquid chromatography, and mass spectrometry.

Also contemplated are biochip-based technologies such as those described by Hacia et al. (1996, *Nature Genetics* 14: 441-447) and Shoemaker et al. (1996, *Nature Genetics* 14: 450-456). Briefly, these techniques involve quantitative methods for analysing large numbers of genes rapidly and accurately. By tagging genes with oligonucleotides or using fixed probe arrays, one can employ biochip technology to segregate target molecules as high density arrays and screen these molecules on the basis of hybridization. See also Pease et al. (1994, *Proc. Natl. Acad. Sci. U.S.A.* 91: 5022-5026); Fodor et al. (1991, *Science* 251: 767-773). Briefly, nucleic acid probes to endotoxemia marker polynucleotides are made and attached to biochips to be used in screening and diagnostic methods, as outlined herein. The nucleic acid probes attached to the biochip are designed to be substantially complementary to specific expressed endotoxemia marker nucleic acids, i.e., the target sequence (either the target sequence of the sample or to other probe sequences, for example in sandwich assays), such that hybridization of the target sequence and the probes of the present invention occurs. This complementarity need not be perfect; there may be any number of base pair mismatches which will interfere with hybridization between the target sequence and the nucleic acid probes of the present invention. However, if the number of mismatches is so great that no hybridization can occur under even the least stringent of hybridization conditions, the sequence is not a complementary target sequence. In certain embodiments, more than one probe per sequence is used, with either overlapping probes or probes to different sections of the target being used. That is, two, three, four or more probes, with three being desirable, are used to build in a redundancy for a particular target. The probes can be overlapping (i.e. have some sequence in common), or separate.

As will be appreciated by those of ordinary skill in the art, nucleic acids can be attached to or immobilized on a solid support in a wide variety of ways. By "immobilized" and grammatical equivalents herein is meant the association or binding between the nucleic acid probe and the solid support is sufficient to be stable under the conditions of binding, washing, analysis, and removal as outlined below. The binding can be covalent or non-covalent. By "non-covalent binding" and grammatical equivalents herein is meant one or more of either electrostatic, hydrophilic, and hydrophobic interactions. Included in non-covalent binding is the covalent attachment of a molecule, such as, streptavidin to the support and the non-covalent binding of the biotinylated probe to the streptavidin. By "covalent binding" and grammatical equivalents herein is meant that the two moieties, the solid support and the probe, are attached by at least one bond, including sigma bonds, pi bonds and coordination bonds. Covalent bonds can be formed directly between the probe and the solid support or can be formed by a cross linker or by inclusion of a specific reactive group on either the solid support or the probe or both molecules. Immobilization may also involve a combination of covalent and non-covalent interactions.

In general, the probes are attached to the biochip in a wide variety of ways, as will be appreciated by those in the art. As described herein, the nucleic acids can either be synthesized first, with subsequent attachment to the biochip, or can be directly synthesized on the biochip.

The biochip comprises a suitable solid or semi-solid substrate or solid support. By "substrate" or "solid support" is meant any material that can be modified to contain discrete individual sites appropriate for the attachment or association of the nucleic acid probes and is amenable to at least one detection method. As will be appreciated by practitioners in the art, the number of possible substrates are very large, and include, but are not limited to, glass and modified or functionalised glass, plastics (including acrylics, polystyrene and copolymers of styrene and other materials, polypropylene, polyethylene, polybutylene, polyurethanes, Teflon™, etc.), polysaccharides, nylon or nitrocellulose, resins, silica or silica-based materials including silicon and modified silicon, carbon, metals, inorganic glasses, plastics, etc. In general, the substrates allow optical detection and do not appreciably fluorescese.

Generally the substrate is planar, although as will be appreciated by those of skill in the art, other configurations of substrates may be used as well. For example, the probes may be placed on the inside surface of a tube, for flow-through sample analysis to minimize sample volume. Similarly, the substrate may be flexible, such as a flexible foam, including closed cell foams made of particular plastics.

In certain embodiments, oligonucleotides probes are synthesized on the substrate, as is known in the art. For example, photoactivation techniques utilizing photopolymerisation compounds and techniques can be used. In an illustrative example, the nucleic acids are synthesized in situ, using well known photolithographic techniques, such as those described in WO 95/25116; WO 95/35505; U.S. Pat. Nos. 5,700,637 and 5,445,934; and references cited within; these methods of attachment form the basis of the Affymetrix GeneChip™ technology.

In an illustrative biochip analysis, oligonucleotide probes on the biochip are exposed to or contacted with a nucleic acid sample suspected of containing one or more endotoxemia polynucleotides under conditions favoring specific hybridization. Sample extracts of DNA or RNA, either single or double-stranded, may be prepared from fluid suspensions of biological materials, or by grinding biological materials, or following a cell lysis step which includes, but is not limited to, lysis effected by treatment with SDS (or other detergents), osmotic shock, guanidinium isothiocyanate and lysozyme. Suitable DNA, which may be used in the method of the invention, includes cDNA. Such DNA may be prepared by any one of a number of commonly used protocols as for example described in Ausubel, et al., 1994, supra, and Sambrook, et al., et al., 1989, supra.

Suitable RNA, which may be used in the method of the invention, includes messenger RNA, complementary RNA transcribed from DNA (cRNA) or genomic or subgenomic RNA. Such RNA may be prepared using standard protocols as for example described in the relevant sections of Ausubel, et al. 1994, supra and Sambrook, et al. 1989, supra).

cDNA may be fragmented, for example, by sonication or by treatment with restriction endonucleases. Suitably, cDNA is fragmented such that resultant DNA fragments are of a length greater than the length of the immobilized oligonucleotide probe(s) but small enough to allow rapid access thereto under suitable hybridization conditions. Alternatively, fragments of cDNA may be selected and amplified using a suitable nucleotide amplification technique, as described for example above, involving appropriate random or specific primers.

Usually the target endotoxemia marker polynucleotides are detectably labeled so that their hybridization to individual probes can be determined. The target polynucleotides are typically detectably labeled with a reporter molecule illustrative examples of which include chromogens, catalysts, enzymes, fluorochromes, chemiluminescent molecules, bioluminescent molecules, lanthanide ions (e.g., $Eu^{34}$), a radioisotope and a direct visual label. In the case of a direct visual label, use may be made of a colloidal metallic or non-metallic particle, a dye particle, an enzyme or a substrate, an organic polymer, a latex particle, a liposome, or other vesicle containing a signal producing substance and the like. Illustrative labels of this type include large colloids, for example, metal colloids such as those from gold, selenium, silver, tin and titanium oxide. In some embodiments in which an enzyme is used as a direct visual label, biotinylated bases are incorporated into a target polynucleotide. Hybridization is detected by incubation with streptavidin-reporter molecules.

Suitable fluorochromes include, but are not limited to, fluorescein isothiocyanate (FITC), tetramethylrhodamine isothiocyanate (TRITC), R-Phycoerythrin (RPE), and Texas Red. Other exemplary fluorochromes include those discussed by Dower et al. (International Publication WO 93/06121). Reference also may be made to the fluorochromes described in U.S. Pat. No. 5,573,909 (Singer et al), U.S. Pat. No. 5,326,692 (Brinkley et al). Alternatively, reference may be made to the fluorochromes described in U.S. Pat. Nos. 5,227,487, 5,274,113, 5,405,975, 5,433,896, 5,442,045, 5,451,663, 5,453,517, 5,459,276, 5,516,864, 5,648,270 and 5,723,218. Commercially available fluorescent labels include, for example, fluorescein phosphoramidites such as Fluoreprime™ (Pharmacia), Fluoredite™ (Millipore) and FAM (Applied Biosystems International)

Radioactive reporter molecules include, for example, $^{32}P$, which can be detected by an X-ray or phosphoimager techniques.

The hybrid-forming step can be performed under suitable conditions for hybridizing oligonucleotide probes to test nucleic acid including DNA or RNA. In this regard, reference may be made, for example, to NUCLEIC ACID HYBRIDIZATION, A PRACTICAL APPROACH (Homes and Higgins, eds.) (IRL press, Washington D.C., 1985). In general, whether hybridization takes place is influenced by the length of the oligonucleotide probe and the polynucleotide sequence under test, the pH, the temperature, the concentration of mono- and divalent cations, the proportion of G and C nucleotides in the hybrid-forming region, the viscosity of the medium and the possible presence of denaturants. Such variables also influence the time required for hybridization. The preferred conditions will therefore depend upon the particular application. Such empirical conditions, however, can be routinely determined without undue experimentation.

In certain advantageous embodiments, high discrimination hybridization conditions are used. For example, reference may be made to Wallace et al. (1979, *Nucl. Acids Res.* 6: 3543) who describe conditions that differentiate the hybridization of 11 to 17 base long oligonucleotide probes that match perfectly and are completely homologous to a target sequence as compared to similar oligonucleotide probes that contain a single internal base pair mismatch. Reference also may be made to Wood et al. (1985, *Proc. Natl. Acid. Sci. USA* 82: 1585) who describe conditions for hybridization of 11 to 20 base long oligonucleotides using 3M tetramethyl ammonium chloride wherein the melting point of the hybrid depends only on the length of the oligonucleotide probe, regardless of its GC content. In addition, Drmanac et al. (supra) describe hybridization conditions that allow stringent hybridization of 6-10 nucleotide long oligomers, and similar conditions may be obtained most readily by using nucleotide analogues such as 'locked nucleic acids (Christensen et al., 2001 *Biochem J* 354: 481-4).

Generally, a hybridization reaction can be performed in the presence of a hybridization buffer that optionally includes a hybridization-optimizing agent, such as an isostabilising agent, a denaturing agent and/or a renaturation accelerant. Examples of isostabilising agents include, but are not restricted to, betaines and lower tetraalkyl ammonium salts. Denaturing agents are compositions that lower the melting temperature of double stranded nucleic acid molecules by interfering with hydrogen bonding between bases in a double stranded nucleic acid or the hydration of nucleic acid molecules. Denaturing agents include, but are not restricted to, formamide, formaldehyde, dimethylsulfoxide, tetraethyl acetate, urea, guanidium isothiocyanate, glycerol and chaotropic salts. Hybridisation accelerants include heterogeneous nuclear ribonucleoprotein (hnRP) A1 and cationic detergents such as cetyltrimethylammonium bromide (CTAB) and dodecyl trimethylammonium bromide (DTAB), polylysine, spermine, spermidine, single stranded binding protein (SSB), phage T4 gene 32 protein and a mixture of ammonium acetate and ethanol. Hybridization buffers may include target polynucleotides at a concentration between about 0.005 nM and about 50 nM, preferably between about 0.5 nM and 5 nM, more preferably between about 1 nM and 2 nM.

A hybridization mixture containing the target endotoxemia marker polynucleotides is placed in contact with the array of probes and incubated at a temperature and for a time appropriate to permit hybridization between the target sequences in the target polynucleotides and any complementary probes. Contact can take place in any suitable container, for example, a dish or a cell designed to hold the solid support on which the probes are bound. Generally, incubation will be at temperatures normally used for hybridization of nucleic acids, for example, between about 20° C. and about 75° C., example, about 25° C., about 30° C., about 35° C., about 40° C., about 45° C., about 50° C., about 55° C., about 60° C., or about 65° C. For probes longer than 14 nucleotides, 20° C. to 50° C. is desirable. For shorter probes, lower temperatures are preferred. A sample of target polynucleotides is incubated with the probes for a time sufficient to allow the desired level of hybridization between the target sequences in the target polynucleotides and any complementary probes. For example, the hybridization may be carried out at about 45° C.+/−10° C. in formamide for 1-2 days.

After the hybrid-forming step, the probes are washed to remove any unbound nucleic acid with a hybridization buffer, which can typically comprise a hybridization optimizing agent in the same range of concentrations as for the hybridization step. This washing step leaves only bound target polynucleotides. The probes are then examined to identify which probes have hybridized to a target polynucleotide.

The hybridization reactions are then detected to determine which of the probes has hybridized to a corresponding target sequence. Depending on the nature of the reporter molecule associated with a target polynucleotide, a signal may be instrumentally detected by irradiating a fluorescent label with light and detecting fluorescence in a fluorimeter; by providing for an enzyme system to produce a dye which could be detected using a spectrophotometer; or detection of a dye particle or a colored colloidal metallic or non metallic particle using a reflectometer; in the case of using a radioactive label or chemiluminescent molecule employing a radiation counter or autoradiography. Accordingly, a detection means may be adapted to detect or scan light associated with the label which light may include fluorescent, luminescent, focussed beam or laser light. In such a case, a charge couple device (CCD) or a photocell can be used to scan for emission of light from a probe:target polynucleotide hybrid from each location in the micro-array and record the data directly in a digital computer. In some cases, electronic detection of the signal may not be necessary. For example, with enzymatically generated color spots associated with nucleic acid array format, visual examination of the array will allow interpretation of the pattern on the array. In the case of a nucleic acid array, the detection means is suitably interfaced with pattern recognition software to convert the pattern of signals from the array into a plain language genetic profile. In certain embodiments, oligonucleotide probes specific for different endotoxemia marker gene products are in the form of a nucleic acid array and detection of a signal generated from a reporter molecule on the array is performed using a 'chip reader'. A detection system that can be used by a 'chip reader' is described for example by Pirrung et al (U.S. Pat. No. 5,143,854). The chip reader will typically also incorporate some signal processing to determine whether the signal at a particular array position or feature is a true positive or maybe a spurious signal. Exemplary chip readers are described for example by Fodor et al (U.S. Pat. No. 5,925,525). Alternatively, when the array is made using a mixture of individually addressable kinds of labeled microbeads, the reaction may be detected using flow cytometry.

7.2 Protein-Based Diagnostics

Consistent with the present invention, the presence of an aberrant concentration of an endotoxemia marker protein is indicative of the presence, degree, or stage of development of an endotoxemia-related condition. Endotoxemia marker protein levels in biological samples can be assayed using any suitable method known in the art. For example, when an endotoxemia marker protein is an enzyme, the protein can be quantified based upon its catalytic activity or based upon the number of molecules of the protein contained in a sample. Antibody-based techniques may be employed, such as, for example, immunohistological and immunohistochemical methods for measuring the level of a protein of interest in a tissue sample. For example, specific recognition is provided by a primary antibody (polyclonal or monoclonal) and a secondary detection system is used to detect presence (or binding) of the primary antibody. Detectable labels can be conjugated to the secondary antibody, such as a fluorescent label, a radiolabel, or an enzyme (e.g., alkaline phosphatase, horseradish peroxidase) which produces a quantifiable, e.g., coloured, product. In another suitable method, the primary antibody itself can be detectably labeled. As a result, immunohistological labeling of a tissue section is provided. In some embodiments, a protein extract is produced from a biological sample (e.g., tissue, cells) for analysis. Such an extract (e.g., a detergent extract) can be subjected to western-blot or dot/slot assay of the level of the protein of interest, using routine immunoblotting methods (Jalkanen et al., 1985, *J. Cell. Biol.* 101: 976-985; Jalkanen et al., 1987, *J. Cell. Biol.* 105: 3087-3096).

Other useful antibody-based methods include immunoassays, such as the enzyme-linked immunosorbent assay (ELISA) and the radioimmunoassay (MA). For example, a protein-specific monoclonal antibody, can be used both as an immunoadsorbent and as an enzyme-labeled probe to detect and quantify an endotoxemia marker protein of interest. The amount of such protein present in a sample can be calculated by reference to the amount present in a standard preparation using a linear regression computer algorithm (see Lacobilli et al., 1988, *Breast Cancer Research and Treatment* 11: 19-30). In other embodiments, two different monoclonal antibodies to the protein of interest can be employed, one as the immunoadsorbent and the other as an enzyme-labeled probe.

Additionally, recent developments in the field of protein capture arrays permit the simultaneous detection and/or quantification of a large number of proteins. For example, low-density protein arrays on filter membranes, such as the universal protein array system (Ge, 2000 *Nucleic Acids Res.* 28(2):e3) allow imaging of arrayed antigens using standard ELISA techniques and a scanning charge-coupled device (CCD) detector. Immuno-sensor arrays have also been developed that enable the simultaneous detection of clinical analytes. It is now possible using protein arrays, to profile protein expression in bodily fluids, such as in sera of healthy or diseased subjects, as well as in subjects pre- and post-drug treatment.

Protein capture arrays typically comprise a plurality of protein-capture agents each of which defines a spatially distinct feature of the array. The protein-capture agent can be any molecule or complex of molecules which has the ability to bind a protein and immobilize it to the site of the protein-capture agent on the array. The protein-capture agent may be a protein whose natural function in a cell is to specifically bind another protein, such as an antibody or a receptor. Alternatively, the protein-capture agent may instead be a partially or wholly synthetic or recombinant protein which specifically binds a protein. Alternatively, the protein-capture agent may be a protein which has been selected in vitro from a mutagenized, randomized, or completely random and synthetic library by its binding affinity to a specific protein or peptide target. The selection method used may optionally have been a display method such as ribosome display or phage display, as known in the art. Alternatively, the protein-capture agent obtained via in vitro selection may be a DNA or RNA aptamer which specifically binds a protein target (see, e.g., Potyrailo et al., 1998 *Anal. Chem.* 70:3419-3425; Cohen et al., 1998, *Proc. Natl. Acad. Sci. USA* 95:14272-14277; Fukuda, et al., 1997 *Nucleic Acids Symp. Ser.* 37:237-238; available from SomaLogic). For example, aptamers are selected from libraries of oligonucleotides by the Selex™ process and their interaction with protein can be enhanced by covalent attachment, through incorporation of brominated deoxyuridine and UV-activated crosslinking (photoaptamers). Aptamers have the advantages of ease of production by automated oligonucleotide synthesis and the stability and robustness of DNA; universal fluorescent protein stains can be used to detect binding. Alternatively, the in vitro selected protein-capture agent may be a polypeptide (e.g., an antigen) (see, e.g., Roberts and Szostak, 1997 *Proc. Natl. Acad. Sci. USA,* 94:12297-12302).

An alternative to an array of capture molecules is one made through 'molecular imprinting' technology, in which peptides (e.g., from the C-terminal regions of proteins) are used as templates to generate structurally complementary, sequence-specific cavities in a polymerisable matrix; the cavities can then specifically capture (denatured) proteins which have the appropriate primary amino acid sequence (e.g., available from ProteinPrint™ and Aspira Biosystems).

Exemplary protein capture arrays include arrays comprising spatially addressed antigen-binding molecules, commonly referred to as antibody arrays, which can facilitate extensive parallel analysis of numerous proteins defining a proteome or subproteome. Antibody arrays have been shown to have the required properties of specificity and acceptable background, and some are available commercially (e.g., BD Biosciences, Clontech, BioRad and Sigma). Various methods for the preparation of antibody arrays have been reported (see, e.g., Lopez et al., 2003 *J. Chromatogr. B* 787:19-27; Cahill, 2000 Trends in Biotechnology 7:47-51; U.S. Pat. App. Pub. 2002/0055186; U.S. Pat. App. Pub. 2003/0003599; PCT publication WO 03/062444; PCT publication WO 03/077851; PCT publication WO 02/59601; PCT publication WO 02/39120; PCT publication WO 01/79849; PCT publication WO 99/39210). The antigen-binding molecules of such arrays may recognise at least a subset of proteins expressed by a cell or population of cells, illustrative examples of which include growth factor receptors, hormone receptors, neurotransmitter receptors, catecholamine receptors, amino acid derivative receptors, cytokine receptors, extracellular matrix receptors, antibodies, lectins, cytokines, serpins, proteases, kinases, phosphatases, ras-like GTPases, hydrolases, steroid hormone receptors, transcription factors, heat-shock transcription factors, DNA-binding proteins, zinc-finger proteins, leucine-zipper proteins, homeodomain proteins, intracellular signal transduction modulators and effectors, apoptosis-related factors, DNA synthesis factors, DNA repair factors, DNA recombination factors, cell-surface antigens, hepatitis C virus (HCV) proteases and HIV proteases.

Antigen-binding molecules for antibody arrays are made either by conventional immunization (e.g., polyclonal sera and hybridomas), or as recombinant fragments, usually expressed in *E. coli*, after selection from phage display or ribosome display libraries (e.g., available from Cambridge Antibody Technology, BioInvent, Affitech and Biosite). Alternatively, 'combibodies' comprising non-covalent associations of VH and VL domains, can be produced in a matrix format created from combinations of diabody-producing bacterial clones (e.g., available from Domantis). Exemplary antigen-binding molecules for use as protein-capture agents include monoclonal antibodies, polyclonal antibodies, Fv, Fab, Fab' and F(ab')$_2$ immunoglobulin fragments, synthetic stabilized Fv fragments, e.g., single chain Fv fragments (scFv), disulfide stabilized Fv fragments (dsFv), single variable region domains (dAbs) minibodies, combibodies and multivalent antibodies such as diabodies and multi-scFv, single domains from camelids or engineered human equivalents.

Individual spatially distinct protein-capture agents are typically attached to a support surface, which is generally planar or contoured. Common physical supports include glass slides, silicon, microwells, nitrocellulose or PVDF membranes, and magnetic and other microbeads.

While microdrops of protein delivered onto planar surfaces are widely used, related alternative architectures include CD centrifugation devices based on developments in microfluidics (e.g., available from Gyros) and specialized chip designs, such as engineered microchannels in a plate (e.g., The Living Chip™, available from Biotrove) and tiny 3D posts on a silicon surface (e.g., available from Zyomyx).

Particles in suspension can also be used as the basis of arrays, providing they are coded for identification; systems include color coding for microbeads (e.g., available from Luminex, Bio-Rad and Nanomics Biosystems) and semiconductor nanocrystals (e.g., QDots™, available from Quantum Dots), and barcoding for beads (UltraPlex™, available from Smartbeads) and multimetal microrods (Nanobarcodes™ particles, available from Surromed). Beads can also be assembled into planar arrays on semiconductor chips (e.g., available from LEAPS technology and BioArray Solutions). Where particles are used, individual protein-capture agents are typically attached to an individual particle to provide the spatial definition or separation of the array. The particles may then be assayed separately, but in parallel, in a compartmentalized way, for example in the wells of a microtiter plate or in separate test tubes.

In operation, a protein sample, which is optionally fragmented to form peptide fragments (see, e.g., U.S. Pat. App. Pub. 2002/0055186), is delivered to a protein-capture array under conditions suitable for protein or peptide binding, and the array is washed to remove unbound or non-specifically bound components of the sample from the array. Next, the presence or amount of protein or peptide bound to each feature of the array is detected using a suitable detection system. The amount of protein bound to a feature of the array may be determined relative to the amount of a second protein bound to a second feature of the array. In certain embodiments, the amount of the second protein in the sample is already known or known to be invariant.

For analyzing differential expression of proteins between two cells or cell populations, a protein sample of a first cell or population of cells is delivered to the array under conditions suitable for protein binding. In an analogous manner, a protein sample of a second cell or population of cells to a second array, is delivered to a second array which is identical to the first array. Both arrays are then washed to remove unbound or non-specifically bound components of the sample from the arrays. In a final step, the amounts of protein remaining bound to the features of the first array are compared to the amounts of protein remaining bound to the corresponding features of the second array. To determine the differential protein expression pattern of the two cells or populations of cells, the amount of protein bound to individual features of the first array is subtracted from the amount of protein bound to the corresponding features of the second array.

In an illustrative example, fluorescence labeling can be used for detecting protein bound to the array. The same instrumentation as used for reading DNA microarrays is applicable to protein-capture arrays. For differential display, capture arrays (e.g. antibody arrays) can be probed with fluorescently labeled proteins from two different cell states, in which cell lysates are labeled with different fluorophores (e.g., Cy-3 and Cy-5) and mixed, such that the color acts as a readout for changes in target abundance. Fluorescent readout sensitivity can be amplified 10-100 fold by tyramide signal amplification (TSA) (e.g., available from PerkinElmer Lifesciences). Planar waveguide technology (e.g., available from Zeptosens) enables ultrasensitive fluorescence detection, with the additional advantage of no washing procedures. High sensitivity can also be achieved with suspension beads and particles, using phycoerythrin as label (e.g., available from Luminex) or the properties of semiconductor nanocrystals (e.g., available from Quantum Dot). Fluorescence resonance energy transfer has been adapted to detect binding of unlabelled ligands, which may be useful on arrays (e.g., available from Affibody). Several alternative readouts have been developed, including adaptations of surface plasmon resonance (e.g., available from HTS Biosystems and Intrinsic Bioprobes), rolling circle DNA amplification (e.g., available from Molecular Staging), mass spectrometry (e.g., available from Sense Proteomic, Ciphergen, Intrinsic and Bioprobes), resonance light scattering (e.g., available from Genicon Sciences) and atomic force microscopy (e.g., available from BioForce Laboratories). A microfluidics system for automated sample incubation with arrays on glass slides and washing has been co-developed by NextGen and Perkin Elmer Life Sciences.

In certain embodiments, the techniques used for detection of endotoxemia marker expression products will include internal or external standards to permit quantitative or semi-quantitative determination of those products, to thereby enable a valid comparison of the level or functional activity of these expression products in a biological sample with the corresponding expression products in a reference sample or samples. Such standards can be determined by the skilled practitioner using standard protocols. In specific examples, absolute values for the level or functional activity of individual expression products are determined.

In specific embodiments, the diagnostic method is implemented using a system as disclosed, for example, in International Publication No. WO 02/090579 and in copending PCT Application No. PCT/AU03/01517 filed Nov. 14, 2003, comprising at least one end station coupled to a base station. The base station is typically coupled to one or more databases comprising predetermined data from a number of individuals representing the level or functional activity of endotoxemia marker expression products, together with indications of the actual status of the individuals (e.g., presence, absence, degree, or stage of development of an endotoxemia-related condition) when the predetermined data was collected. In operation, the base station is adapted to receive from the end station, typically via a communications network, subject data representing a measured or normalized level or functional activity of at least one expression product in a biological sample obtained from a test subject and to compare the subject data to the predetermined data stored in the database(s). Comparing the subject and predetermined data allows the base station to determine the status of the subject in accordance with the results of the comparison. Thus, the base station attempts to identify individuals having similar parameter values to the test subject and once the status has been determined on the basis of that identification, the base station provides an indication of the diagnosis to the end station.

7.3 Kits

All the essential materials and reagents required for detecting and quantifying endotoxemia maker gene expression products may be assembled together in a kit. The kits may also optionally include appropriate reagents for detection of labels, positive and negative controls, washing solutions, blotting membranes, microtiter plates dilution buffers and the like. For example, a nucleic acid-based detection kit may include (i) an endotoxemia marker polynucleotide (which may be used as a positive control), (ii) a primer or probe that specifically hybridizes to an endotoxemia marker polynucleotide. Also included may be enzymes suitable for amplifying nucleic acids including various polymerases (Reverse Transcriptase, Taq, Sequenase™ DNA ligase etc. depending on the nucleic acid amplification technique employed), deoxynucleotides and buffers to provide the necessary reaction mixture for amplification. Such kits also generally will comprise, in suitable means, distinct containers for each individual reagent and enzyme as well as for each primer or probe. Alternatively, a protein-based detection kit may include (i) an endotoxemia marker polypeptide (which may be used as a positive control), (ii) an antigen-binding molecule that is immuno-interactive with an endotoxemia marker polynucleotide. The kit can also feature various devices and reagents for performing one of the assays described herein; and/or printed instructions for using the kit to quantify the expression of an endotoxemia marker gene.

8. Methods of Treatment or Prophylaxis

The present invention also extends to the management of endotoxaemia-related conditions, or prevention of further progression of endotoxaemia-related conditions, or assessment of the efficacy of therapies in subjects following positive diagnosis for the presence, or stage of endotoxaemia-related conditions in the subjects. Generally, the management of endotoxaemia-related conditions is highly intensive and can include identification and amelioration of the underlying cause and aggressive use of therapeutic compounds such as, vasoactive compounds, antibiotics, steroids, antibodies to endotoxin, and anti tumour necrosis factor agents. In addition, palliative therapies[1] aimed at restoring and protecting organ function can be used such as intravenous fluids and oxygen.

[1] Cohen J & Glauser M P, Lancet 338: 736-739 (1991).

Typically, the therapeutic agents will be administered in pharmaceutical (or veterinary) compositions together with a pharmaceutically acceptable carrier and in an effective amount to achieve their intended purpose. The dose of active compounds administered to a subject should be sufficient to achieve a beneficial response in the subject over time such as a reduction in, or relief from, the symptoms of endotoxaemia. The quantity of the pharmaceutically active compounds(s) to be administered may depend on the subject to be treated inclusive of the age, sex, weight and general health condition thereof. In this regard, precise amounts of the active compound(s) for administration will depend on the judgement of the practitioner. In determining the effective amount of the active compound(s) to be administered in the treatment or prevention of endotoxaemia, the medical practitioner or veterinarian may evaluate severity of any symptom associated with the presence of endotoxaemia including tachycardia, fever, chills, vomiting, diarrhoea, skin rash, headaches, confusion, muscle aches, seizures. In any event, those of skill in the art may readily determine suitable dosages of the therapeutic agents and suitable treatment regimens without undue experimentation.

The therapeutic agents may by administered in concert with adjunctive (palliative) therapies to increase oxygen supply to major organs, increase blood flow to major organs and/or to reduce the inflammatory response. Illustrative examples of such adjunctive therapies include non steroidal-anti inflammatory drugs (NSAIDs), intravenous saline and oxygen.

In order that the invention may be readily understood and put into practical effect, particular preferred embodiments will now be described by way of the following non-limiting examples.

EXAMPLES

Example 1

Identification of Specific Diagnostic Genes for Endotoxaemia-Related Conditions

Experimental Disease Trial Design

A clinical trial was performed on three blocks of fours horses each. The first block consisted of four horses that were dosed orally with 12.5 mg/kg of oligofructose[2] as part of the trial procedure described by Pollitt[3] which is specifically designed to induce endotoxaemia and subsequent acute laminitis. The second block consisted of four horses that underwent the same trial procedure but were dosed with normal saline (0.9%) solution (controls). The same four horses in the second block then underwent the trial procedure (following a period of recovery) for a second time but were dosed with oligofructose (block three). All horses were stalled under the same conditions for the duration of the procedure (120 hours).

[2] Raftilose®, Orafti Active Food Ingredients, Aanndorenstraat, B-3300 Tienen, Belgium.
[3] van Eps A & Pollitt C C. Equine Vet J. 36(3):255-60 (2004).

Endotoxaemia-related conditions in horses (including laminitis) can be induced experimentally and one of the more reliable methods of induction is by carbohydrate overload through oral dosing with oligofructose.

Blood samples were collected at four time points—Hour 0 prior to dosing and at hours 24, 48, and 72 hours after dosing. The sample at Hour 0 acted as a control for each horse.

The following tests and observations were undertaken at all of the above time points:

(i) physical examination, rectal temperature, digital pulse, hoof temperature, heart and respiratory rate, faecal pH, hoof shifting; and (ii) haematology and biochemistry.

Blood samples from each of the animals on Hours 0, 24, 48 and 72 of the trial were analysed using GeneChips™ (method of use is described below in detail in "Generation of Gene Expression Data") containing thousands of genes expressed in white blood cells of horses. Analysis of these data (see "Identification of Diagnostic Marker Genes" below) reveals a number of specific genes that differ in expression between animals before and after experimental induction of endotoxaemia and laminitis from Hour 24 following dosing. It is possible to design an assay that measures the RNA level in the sample from the expression of at least one and desirably at least two endotoxaemia marker genes, representative transcript sequences of which are set forth in SEQ ID NO: 1, 3, 4, 5, 6, 7, 9, 10, 11, 13, 15, 16, 17, 18, 19, 21, 23, 25, 26, 27, 29, 31, 33, 35, 37, 38, 39, 41, 42, 43, 44, 45, 47, 49, 50, 52, 54, 56, 58, 60, 61, 63, 64, 66, 67, 68, 69, 70, 71, 73, 75, 76, 77, 78, 79, 80, 81, 82, 83, 84, 86, 88, 90, 92, 93, 94, 96, 98, 100, 101, 102, 103, 104, 106, 107, 109, 110, 111, 113, 114, 115, 117, 119, 121, 122, 123, 124, 125, 126, 128, 130, 132, 134, 136, 137, 139, 141, 143, 145, 147, 149, 151, 153, 155, 157, 158, 160, 162, 164, 166, 168, 169, 170, 172, 173, 174, 176, 178, 180, 182, 184, 186, 188, 190, 192, 193, 194, 195, 197, 199, 201, 203, 205, 206, 207, 209, 210, 211, 212, 214, 215, 216, 218, 220, 222, 223, 224, 225, 227, 229, 231, 233, 235, 236, 237, 239, 240, 242, 244, 245, 246, 248, 250, 252, 254, 255, 257, 259 260, 262, 264, 266, 268, 269, 270, 271, 272, 274, 276, 278, 279, 280, 282, 284, 286, 288, 290, 292, 294, 296, 298, 300, 302, 304, 305, 306, 307, 309, 311, 312, 314, 315, 316, 318, 320 321, 323 or 325.

Materials and Methods

Blood Collection

Blood is collected from a horse (in a non-agitated state) for the purpose of extraction of high quality RNA or protein. Suitable blood collection tubes for the collection, preservation, transport and isolation of RNA include PAXgene™ tubes (PreAnalytix Inc., Valencia, Calif., USA). Alternatively, blood can be collected into tubes containing solutions designed for the preservation of nucleic acids (available from Roche, Ambion, Invitrogen and ABI). For the determination of protein levels, 50 mL of blood is prevented from clotting by collection into a tube containing 4 mL of 4% sodium citrate. White blood cells and plasma are isolated and stored frozen for later analysis and detection of specific proteins. PAXgene tubes can be kept at room temperature prior to RNA extraction. Clinical signs are recorded in a standard format.

Total RNA Extraction

A kit available from Qiagen Inc (Valencia, Calif., USA) has the reagents and instructions for the isolation of total RNA from 2.5 mL blood collected in the PAXgene Blood RNA Tube. Isolation begins with a centrifugation step to pellet nucleic acids in the PAXgene blood RNA tube. The pellet is washed and resuspended and incubated in optimized buffers together with Proteinase K to bring about protein digestion. An additional centrifugation is carried out to remove residual cell debris and the supernatant is transferred to a fresh microcentrifuge tube. Ethanol is added to adjust binding conditions, and the lysate is applied to the PAXgene RNA spin column. During brief centrifugation, RNA is selectively bound to the silica-gel membrane as contaminants pass through. Remaining contaminants are removed in three efficient wash steps and RNA is then eluted in Buffer BR5.

Determination of RNA quantity and quality is necessary prior to proceeding and can be achieved using an Agilent Bioanalyzer and Absorbance 260/280 ratio using a spectrophotometer.

Generation of Gene Expression Data

Choice of Method

Measurement of specific RNA levels in a tissue sample can be achieved using a variety of technologies. Two common and readily available technologies that are well known in the art are:

GeneChip® analysis using Affymetrix technology.
Real-Time Polymerase Chain Reaction (TaqMan™ from Applied Biosystems for example).

GeneChips® quantitate RNA by detection of labeled cRNA hybridized to short oligonucleotides built on a silicon substrate. Details on the technology and methodology can be found at www.affymetrix.com.

Real-Time Polymerase Chain Reaction (RT-PCR) quantitates RNA using two PCR primers, a labeled probe and a thermostable DNA polymerase. As PCR product is generated a dye is released into solution and detected. Internal controls such as 18S RNA probes are often used to determine starting levels of total RNA in the sample. Each gene and the internal control are run separately. Details on the technology and methods can be found at www.appliedbiosytems.com or www.qiagen.com or www.biorad.com. Applied Biosystems offer a service whereby the customer provides DNA sequence information and payment and is supplied in return all of the reagents required to perform RT-PCR analysis on individual genes.

GeneChip® analysis has the advantage of being able to analyze thousands of genes at a time. However it is expensive and takes over 3 days to perform a single assay. RT-PCR generally only analyses one gene at a time, but is inexpensive and can be completed within a single day.

RT-PCR is the method of choice for gene expression analysis if the number of specific genes to be analyzed is less than 20. GeneChip® or other gene expression analysis technologies (such as Illumina Bead Arrays) are the method of choice when many genes need to be analyzed simultaneously.

The methodology for GeneChip® data generation and analysis and Real Time PCR is presented below in brief.

GeneChip® Data Generation cDNA & cRNA Generation

The following method for cDNA and cRNA generation from total RNA has been adapted from the protocol provided and recommended by Affymetrix (www.affymetrix.com).

The steps are:
A total of 3 µg of total RNA is used as a template to generate double stranded cDNA.
cRNA is generated and labeled using biotinylated Uracil (dUTP).
biotin-labeled cRNA is cleaned and the quantity determined using a spectrophotometer and MOPS gel analysis.
labeled cRNA is fragmented to ~300 bp in size.
RNA quantity is determined on an Agilent "Lab-on-a-Chip" system (Agilent Technologies).

Hybridization, Washing & Staining

The steps are:
A hybridization cocktail is prepared containing 0.05 µg/µL of labeled and fragmented cRNA, spike-in positive hybridization controls, and the Affymetrix oligonucleotides B2, bioB, bioC, bioD and cre.
The final volume (80 µL) of the hybridization cocktail is added to the GeneChip® cartridge.
The cartridge is placed in a hybridization oven at constant rotation for 16 hours.
The fluid is removed from the GeneChip® and stored.
The GeneChip® is placed in the fluidics station.
The experimental conditions for each GeneChip® are recorded as an .EXP file.
All washing and staining procedures are carried out by the Affymetrix fluidics station with an attendant providing the appropriate solutions.
The GeneChip® is washed, stained with steptavidin-phycoerythin dye and then washed again using low salt solutions.
After the wash protocols are completed, the dye on the probe array is 'excited' by laser and the image captured by a CCD camera using an Affymetrix Scanner (manufactured by Agilent).

Scanning & Data File Generation

The scanner and MAS 5 software generates an image file from a single GeneChip® called a .DAT file (see figure overleaf).
The .DAT file is then pre-processed prior to any statistical analysis.
Data pre-processing steps (prior to any statistical analysis) include:
.DAT File Quality Control (QC).
.CEL File Generation.
Scaling and Normalization.

.DAT File Quality Control

The .DAT file is an image. The image is inspected manually for artifacts (e.g. high/low intensity spots, scratches, high regional or overall background). (The B2 oligonucleotide hybridization performance is easily identified by an alternating pattern of intensities creating a border and array name.) The MAS 5 software used the B2 oligonucleotide border to align a grid over the image so that each square of oligonucleotides was centered and identified.

The other spiked hybridization controls (bioB, bioC, bioD and cre) are used to evaluate sample hybridization efficiency by reading "present" gene detection calls with increasing signal values, reflecting their relative concentrations. (If the .DAT file is of suitable quality it is converted to an intensity data file (.CEL file) by Affymetrix MAS 5 software).

.CEL File Generation

The .CEL files generated by the MAS 5 software from .DAT files contain calculated raw intensities for the probe sets. Gene expression data is obtained by subtracting a calculated background from each cell value. To eliminate negative intensity values, a noise correction fraction based from a local noise value from the standard deviation of the lowest 2% of the background is applied.

All .CEL files generated from the GeneChips® are subjected to specific quality metrics parameters.

Some metrics are routinely recommended by Affymetrix and can be determined from Affymetrix internal controls provided as part of the GeneChip®. Other metrics are based on experience and the processing of many GeneChips®.

Analysis of GeneChip® Data

Two illustrative approaches to normalising data may be used:
Affymetrix MAS 5 Algorithm.
Robust Multi-chip Analysis (RMA) algorithm of Irizarry (Irizarray et al., 2002, *Biostatistics* (in print)).

Those of skill in the art will recognise that many other approaches might be adopted, without materially affecting the invention.

Affymetrix MAS 5 Algorithm

.CEL files are used by Affymetrix MAS 5 software to normalize or scale the data. Scaled data from one chip are compared to similarly scaled data from other chips.

Affymetrix MAS 5 normalization is achieved by applying the default "Global Scaling" option of the MAS 5 algorithm to the .CEL files. This procedure subtracts a robust estimate of the center of the distribution of probe values, and divides by a robust estimate of the probe variability. This produces a set of chips with common location and scale at the probe level.

Gene expression indices are generated by a robust averaging procedure on all the probe pairs for a given gene. The results are constrained to be non-negative.

Given that scaling takes place at the level of the probe, rather than at the level of the gene, it is possible that even after normalization there may be chip-to-chip differences in overall gene expression level. Following standard MASS normalization, values for each gene were de-trended with respect to median chip intensity. That is, values for each gene were regressed on the median chip intensity, and residuals were calculated. These residuals were taken as the de-trended estimates of expression for each gene Median chip intensity was calculated using the Affymetrix MASS algorithm, but with a scale factor fixed at one.

RMA Algorithm

This algorithm quantifies the expression of a set of chips, rather than of a single chip. It estimates background intensities using a robust statistical model applied to perfect match probe data. It does not make use of mis-match probe data. Following implicit background correction, chips are processed using Quantile Quantile normalization (Rizarray et al., 2002, *Biostatistics* (in print)).

DNA Extraction

A kit available from Qiagen Inc (Valencia, Calif., USA) has the reagents and instructions for the isolation of total DNA from 8.5 mL blood collected in the PAXgene Blood DNA Tube. Isolation begins with the addition of additional lysis solution followed by a centrifugation step. The pellet is washed and resuspended and incubated in optimized buffers together with Proteinase K to bring about protein digestion. DNA is precipitated using alcohol and an additional centrifugation is carried out to pellet the nucleic acid. Remaining contaminants are removed in a wash step and the DNA is then resuspended in Buffer BG4.

Determination of DNA quantity and quality is necessary prior to proceeding and can be achieved using a spectrophotometer or agarose gel electrophoresis.

Genotyping Analysis

Many methods are available to genotype DNA. A review of allelic discrimination methods can be found in Kristensen et al. (Biotechniques 30(2): 318-322 (2001). An illustrative method for genotyping using allele-specific PCR is described here.

Primer Design

Upstream and downstream PCR primers specific for particular alleles can be designed using freely available computer programs, such as Primer3 (frodo.wi.mit.edu/primer3/primer3 code.html). Alternatively the DNA sequences of the various alleles can be aligned using a program such as ClustalW (www.ebi.ac.uk/clustalw/) and specific primers designed to areas where DNA sequence differences exist but retaining enough specificity to ensure amplification of the correct amplicon. Preferably a PCR amplicon is designed to have a restriction enzyme site in one allele but not the other. Primers are generally 18-25 base pairs in length with similar melting temperatures.

PCR Amplification

The composition of PCR reactions has been described elsewhere (Clinical Applications of PCR, Dennis Lo (Editor), Blackwell Publishing, 1998). Briefly, a reaction contains primers, DNA, buffers and a thermostable polymerase enzyme. The reaction is cycled (up to 50 times) through temperature steps of denaturation, hybridization and DNA extension on a thermocycler such as the MJ Research Thermocycler model PTC-96V.

DNA Analysis

PCR products can be analyzed using a variety of methods including size differentiation using mass spectrometry, capillary gel electrophoresis and agarose gel electrophoresis. If the PCR amplicons have been designed to contain differential restriction enzyme sites, the DNA in the PCR reaction is purified using DNA-binding columns or precipitation and re-suspended in water, and then restricted using the appropriate restriction enzyme. The restricted DNA can then be run on an agarose gel where DNA is separated by size using electric current. Various alleles of a gene will have different sizes depending on whether they contain restriction sites. Thus, homozygotes and heterozygotes can be determined.

Real-Time PCR Data Generation

Background information for conducting Real-time PCR may be obtained, for example, at dorakmt.tripod.com/genetics/realtime.html and in a review by Bustin SA (2000, *J Mol Endocrinol* 25:169-193).

TaqMan™ Primer and Probe Design Guidelines

1. The Primer Express™ (ABI) software designs primers with a melting temperature (Tm) of 58-60° C., and probes with a Tm value of 10° C. higher. The Tm of both primers should be equal.
2. Primers should be 15-30 bases in length.
3. The G+C content should ideally be 30-80%. If a higher G+C content is unavoidable, the use of high annealing and melting temperatures, cosolvents such as glycerol, DMSO, or 7-deaza-dGTP may be necessary.
4. The run of an identical nucleotide should be avoided. This is especially true for G, where runs of four or more Gs is not allowed.
5. The total number of Gs and Cs in the last five nucleotides at the 3' end of the primer should not exceed two (the newer version of the software has an option to do this automatically). This helps to introduce relative instability to the 3' end of primers to reduce non-specific priming. The primer conditions are the same for SYBR Green assays.
6. Maximum amplicon size should not exceed 400 bp (ideally 50-150 bases). Smaller amplicons give more consistent results because PCR is more efficient and more tolerant of reaction conditions (the short length requirement has nothing to do with the efficiency of 5' nuclease activity).
7. The probes should not have runs of identical nucleotides (especially four or more consecutive Gs), G+C content should be 30-80%, there should be more Cs than Gs, and not a G at the 5' end. The higher number of Cs produces a higher ΔRn. The choice of probe should be made first.
8. To avoid false-positive results due to amplification of contaminating genomic DNA in the cDNA preparation, it is preferable to have primers spanning exon-exon junctions. This way, genomic DNA will not be amplified (the PDAR kit for human GAPDH amplification has such primers),
9. If a TaqMan™ probe is designed for allelic discrimination, the mismatching nucleotide (the polymorphic site) should be in the middle of the probe rather than at the ends,
10. Use primers that contain dA nucleotides near the 3' ends so that any primer-dimer generated is efficiently degraded by AmpErase™ UNG (mentioned in p. 9 of the manual for EZ RT-PCR kit; P/N 402877). If primers cannot be selected with dA nucleotides near the ends, the use of primers with 3' terminal dU-nucleotides should be considered.

(See also the general principles of PCR Primer Design by InVitroGen.)

General Method

1. Reverse transcription of total RNA to cDNA should be done with random hexamers (not with oligo-dT). If oligo-dT has to be used long mRNA transcripts or amplicons greater than two kilobases upstream should be avoided, and 18S RNA cannot be used as normalizer,
2. Multiplex PCR will only work properly if the control primers are limiting (ABI control reagents do not have their primers limited),
3. The range of target cDNA used is 10 ng to 1 µg. If DNA is used (mainly for allelic discrimination studies), the optimum amount is 100 ng to 1 µg,
4. It is ideal to treat each RNA preparation with RNAse free DNAse to avoid genomic DNA contamination. Even the best RNA extraction methods yield some genomic DNA. Of course, it is ideal to have primers not amplifying genomic DNA at all but sometimes this may not be possible,
5. For optimal results, the reagents (before the preparation of the PCR mix) and the PCR mixture itself (before loading) should be vortexed and mixed well. Otherwise there may be shifting Rn value during the early (0-5) cycles of PCR. It is also important to add probe to the buffer component and allow it to equilibrate at room temperature prior to reagent mix formulation.

TaqMan™ Primers and Probes

The TaqMan™ probes ordered from ABI at midi-scale arrive already resuspended at 100 µM. If a 1/20 dilution is made, this gives a 5 µM solution. This stock solution should be aliquoted, frozen and kept in the dark. Using 1 µL of this in a 50 µL reaction gives the recommended 100 nM final concentration.

The primers arrive lyophilized with the amount given on the tube in pmols (such as 150.000 pmol which is equal to 150 nmol). If X nmol of primer is resuspended in X µL of H$_2$O, the resulting solution is 1 mM. It is best to freeze this stock solution in aliquots. When the 1 mM stock solution is diluted 1/100, the resulting working solution will be 10 µM. To get the recommended 50-900 nM final primer concentration in 50 µL reaction volume, 0.25-4.50 µL should be used per reaction (2.5 µL for 500 nM final concentration).

The PDAR primers and probes are supplied as a mix in one tube. They have to be used 2.5 µL in a 50 µL reaction volume.

Setting Up One-Step TaqMan™ Reaction

One-step real-time PCR uses RNA (as opposed to cDNA) as a template. This is the preferred method if the RNA solution has a low concentration but only if singleplex reactions are run. The disadvantage is that RNA carryover prevention enzyme AmpErase cannot be used in one-step reaction format. In this method, both reverse transcriptase and real-time PCR take place in the same tube. The downstream PCR primer also acts as the primer for reverse transcriptase (random hexamers or oligo-dT cannot be used for reverse transcription in one-step RT-PCR). One-step reaction requires higher dNTP concentration (greater than or equal to 300 mM vs 200 mM) as it combines two reactions needing dNTPs in one. A typical reaction mix for one-step PCR by Gold RT-PCR kit is as follows:

| Reagents | Volume |
| --- | --- |
| H$_2$O + RNA: | 20.5 µL [24 µL if PDAR is used] |
| 10X TaqMan buffer: | 5.0 µL |
| MgCl$_2$ (25 mM): | 11.0 µL |
| dATP (10 mM): | 1.5 µL [for final concentration of 300 µM] |
| dCTP (10 mM): | 1.5 µL [for final concentration of 300 µM] |
| dGTP (10 mM): | 1.5 µL [for final concentration of 300 µM] |
| dUTP (20 mM): | 1.5 µL [for final concentration of 600 µM] |
| Primer F (10 µM) *: | 2.5 µL [for final concentration of 500 nM] |

| Reagents | Volume |
| --- | --- |
| Primer R (10 μM) *: | 2.5 μL [for final concentration of 500 nM] |
| TaqMan Probe *: | 1.0 μL [for final concentration of 100 nM] |
| AmpliTaq Gold: | 0.25 μL [can be increased for higher efficiency] |
| Reverse Transcriptase: | 0.25 μL |
| RNAse inhibitor: | 1.00 μL |

* If a PDAR is used, 2.5 μL of primer + probe mix used.

Ideally 10 pg-100 ng RNA should be used in this reaction. Note that decreasing the amount of template from 100 ng to 50 ng will increase the $C_T$ value by 1. To decrease a $C_T$ value by 3, the initial amount of template should be increased 8-fold. ABI claims that 2 picograms of RNA can be detected by this system and the maximum amount of RNA that can be used is 1 microgram. For routine analysis, 10 pg-100 ng RNA and 100 pg-1 μg genomic DNA can be used.

Cycling Parameters for One-Step PCR

Reverse transcription (by MuLV) 48° C. for 30 min.
AmpliTaq activation 95° C. for 10 min.
PCR: denaturation 95° C. for 15 sec and annealing/extension 60° C. for 1 min (repeated 40 times) (On ABI 7700, minimum holding time is 15 seconds.)
The recently introduced EZ One-Step™ RT-PCR kit allows the use of UNG as the incubation time for reverse transcription is 60° C. thanks to the use of a thermostable reverse transcriptase. This temperature also a better option to avoid primer dimers and non-specific bindings at 48° C.

Operating the ABI 7700

Make sure the following before starting a run:
1. Cycle parameters are correct for the run.
2. Choice of spectral compensation is correct (off for singleplex, on for multiplex reactions).
3. Choice of "Number of PCR Stages" is correct in the Analysis Options box (Analysis/Options). This may have to be manually assigned after a run if the data is absent in the amplification plot but visible in the plate view, and the X-axis of the amplification is displaying a range of 0-1 cycles.
4. No Template Control is labeled as such (for accurate ΔRn calculations).
5. The choice of dye component should be made correctly before data analysis.
6. You must save the run before it starts by giving it a name (not leaving as untitled). Also at the end of the run, first save the data before starting to analyze.
7. The ABI software requires extreme caution. Do not attempt to stop a run after clicking on the Run button. You will have problems and if you need to switch off and on the machine, you have to wait for at least an hour to restart the run.

When analyzing the data, remember that the default setting for baseline is 3-15. If any $C_T$ value is <15, the baseline should be changed accordingly (the baseline stop value should be 1-2 smaller than the smallest $C_T$ value). For a useful discussion of this matter, see the ABI Tutorial on Setting Baselines and Thresholds. (Interestingly, this issue is best discussed in the manual for TaqMan™ Human Endogenous Control Plate.)

If the results do not make sense, check the raw spectra for a possible CDC camera saturation during the run. Saturation of CDC camera may be prevented by using optical caps rather than optical adhesive cover. It is also more likely to happen when SYBR Green I is used, when multiplexing and when a high concentration of probe is used.

Interpretation of Results

At the end of each reaction, the recorded fluorescence intensity is used for the following calculations:
$Rn^+$ is the Rn value of a reaction containing all components, $Rn^-$ is the Rn value of an unreacted sample (baseline value or the value detected in NTC). ΔRn is the difference between $Rn^+$ and $Rn^-$. It is an indicator of the magnitude of the signal generated by the PCR.
There are three illustrative methods to quantitate the amount of template:
1. Absolute standard method: In this method, a known amount of standard such as in vitro translated RNA (cRNA) is used.
2. Relative standard: Known amounts of the target nucleic acid are included in the assay design in each run,
3. Comparative $C_T$ method: This method uses no known amount of standard but compares the relative amount of the target sequence to any of the reference values chosen and the result is given as relative to the reference value (such as the expression level of resting lymphocytes or a standard cell line).

The Comparative CT Method (ΔΔCT) for Relative Quantitation of Gene Expression This method enables relative quantitation of template and increases sample throughput by eliminating the need for standard curves when looking at expression levels relative to an active reference control (normalizer). For this method to be successful, the dynamic range of both the target and reference should be similar. A sensitive method to control this is to look at how $\Delta C_T$ (the difference between the two CT values of two PCRs for the same initial template amount) varies with template dilution. If the efficiencies of the two amplicons are approximately equal, the plot of log input amount versus $\Delta C_T$ will have a nearly horizontal line (a slope of <0.10). This means that both PCRs perform equally efficiently across the range of initial template amounts. If the plot shows unequal efficiency, the standard curve method should be used for quantitation of gene expression. The dynamic range should be determined for both (1) minimum and maximum concentrations of the targets for which the results are accurate and (2) minimum and maximum ratios of two gene quantities for which the results are accurate. In conventional competitive RT-PCR, the dynamic range is limited to a target-to-competitor ratio of about 10:1 to 1:10 (the best accuracy is obtained for 1:1 ratio). The real-time PCR is able to achieve a much wider dynamic range.

Running the target and endogenous control amplifications in separate tubes and using the standard curve method requires the least amount of optimization and validation. The advantage of using the comparative $C_T$ method is that the need for a standard curve is eliminated (more wells are available for samples). It also eliminates the adverse effect of any dilution errors made in creating the standard curve samples.

As long as the target and normalizer have similar dynamic ranges, the comparative $C_T$ method ($\Delta \Delta C_T$ method) is the most practical method. It is expected that the normalizer will have a higher expression level than the target (thus, a smaller $C_T$ value). The calculations for the quantitation start with getting the difference ($\Delta C_T$) between the $C_T$ values of the target and the normalizer:

$$\Delta C_T = C_T(\text{target}) - C_T(\text{normalizer})$$

This value is calculated for each sample to be quantitated (unless, the target is expressed at a higher level than the normalizer, this should be a positive value. It is no harm if it is negative). One of these samples should be chosen as the reference (baseline) for each comparison to be made. The comparative $\Delta\Delta C_T$ calculation involves finding the difference between each sample's $\Delta C_T$ and the baseline's $\Delta C_T$. If the baseline value is representing the minimum level of expression, the $\Delta\Delta C_T$ values are expected to be negative (because the $\Delta C_T$ for the baseline sample will be the largest as it will have the greatest $C_T$ value). If the expression is increased in some samples and decreased in others, the $\Delta\Delta C_T$ values will be a mixture of negative and positive ones. The last step in quantitation is to transform these values to absolute values. The formula for this is:

$$\text{comparative expression level} = 2^{-\Delta\Delta C_T}$$

For expressions increased compared to the baseline level this will be something like $2^3=8$ times increase, and for decreased expression it will be something like $2^{-3}=1/8$ of the reference level. Microsoft Excel can be used to do these calculations by simply entering the CT values (there is an online ABI tutorial at www.appliedbiosystems.com/support/tutorials/7700amp/ on the use of spread sheet programs to produce amplification plots; the TaqManTm Human Endogenous Control Plate protocol also contains detailed instructions on using MS Excel for real-time PCR data analysis).

The other (absolute) quantification methods are outlined in the ABI User Bulletins (docs.appliedbiosystems.com/search.taf?UserReference=A8658327189850A13AOC598 E). The Bulletins #2 and #5 are most useful for the general understanding of real-time PCR and quantification.

Recommendations on Procedures:

1. Use positive-displacement pipettes to avoid inaccuracies in pipetting,

2. The sensitivity of real-time PCR allows detection of the target in 2 pg of total RNA. The number of copies of total RNA used in the reaction should ideally be enough to give a signal by 25-30 cycles (preferably less than 100 ng). The amount used should be decreased or increased to achieve this.

3. The optimal concentrations of the reagents are as follows:

i. Magnesium chloride concentration should be between 4 and 7 mM. It is optimized as 5.5 mM for the primers/probes designed using the Primer Express software.

ii. Concentrations of dNTPs should be balanced with the exception of dUTP (if used). Substitution of dUTP for dTTP for control of PCR product carryover requires twice dUTP that of other dNTPs. While the optimal range for dNTPs is 500 μM to 1 mM (for one-step RT-PCR), for a typical TaqMan reaction (PCR only), 200 μM of each dNTP (400 μM of dUTP) is used.

iii. Typically 0.25 μL (1.25 U) AmpliTaq DNA Polymerase (5.0 U/μL) is added into each 50 μL reaction. This is the minimum requirement. If necessary, optimization can be done by increasing this amount by 0.25 U increments.

iv. The optimal probe concentration is 50-200 nM, and the primer concentration is 100-900 nM. Ideally, each primer pair should be optimized at three different temperatures (58, 60 and 62° C. for TaqMan primers) and at each combination of three concentrations (50, 300, 900 nM). This means setting up three different sets (for three temperatures) with nine reactions in each (50/50 mM, 50/300 mM, 50/900, 300/50, 300/300, 300/900, 900/50, 900/300, 900/900 mM) using a fixed amount of target template. If necessary, a second round of optimization may improve the results. Optimal performance is achieved by selecting the primer concentrations that provide the lowest $C_T$ and highest $\Delta$Rn. Similarly, the probe concentration should be optimized for 25-225 nM.

4. If AmpliTaq Gold DNA Polymerase is being used, there has to be a 9-12 mM pre-PCR heat step at 92-95° C. to activate it. If AmpliTaq Gold DNA Polymerase is used, there is no need to set up the reaction on ice. A typical TaqMan reaction consists of 2 min at 50° C. for UNG (see below) incubation, 10 min at 95° C. for Polymerase activation, and 40 cycles of 15 sec at 95° C. (denaturation) and 1 min at 60° C. (annealing and extension). A typical reverse transcription cycle (for cDNA synthesis), which should precede the TaqMan reaction if the starting material is total RNA, consists of 10 min at 25° C. (primer incubation), 30 min at 48° C. (reverse transcription with conventional reverse transcriptase) and 5 min at 95° C. (reverse transcriptase inactivation).

5. AmpErase uracil-N-glycosylase (UNG) is added in the reaction to prevent the reamplification of carry-over PCR products by removing any uracil incorporated into amplicons. This is why dUTP is used rather than dTTP in PCR reaction. UNG does not function above 55° C. and does not cut single-stranded DNA with terminal dU nucleotides. UNG-containing master mix should not be used with one-step RT-PCR unless rTth DNA polymerase is being used for reverse transcription and PCR (TaqMan EZ RT-PCR kit).

6. It is necessary to include at least three No Amplification Controls (NAC) as well as three No Template Controls (NTC) in each reaction plate (to achieve a 99.7% confidence level in the definition of +/− thresholds for the target amplification, six replicates of NTCs must be run). NAC former contains sample and no enzyme. It is necessary to rule out the presence of fluorescence contaminants in the sample or in the heat block of the thermal cycler (these would cause false positives). If the absolute fluorescence of the NAC is greater than that of the NTC after PCR, fluorescent contaminants may be present in the sample or in the heating block of the thermal cycler.

7. The dynamic range of a primer/probe system and its normalizer should be examined if the $\Delta\Delta C_T$ method is going to be used for relative quantitation. This is done by running (in triplicate) reactions of five RNA concentrations (for example, 0, 80 pg/μL, 400 pg/μL, 2 ng/μL and 50 ng/μL). The resulting plot of log of the initial amount vs $C_T$ values (standard curve) should be a (near) straight line for both the target and normalizer real-time RT-PCRs for the same range of total RNA concentrations.

8. The passive reference is a dye (ROX) included in the reaction (present in the TaqMan universal PCR master mix). It does not participate in the 5' nuclease reaction. It provides an internal reference for background fluorescence emission. This is used to normalize the reporter-dye signal. This normalization is for non-PCR-related fluorescence fluctuations occurring well-to-well (concentration or volume differences) or over time and different from the normalization for the amount of cDNA or efficiency of the PCR. Normalization is achieved by dividing the emission intensity of reporter dye by the emission intensity of the passive reference. This gives the ratio defined as Rn.

9. If multiplexing is done, the more abundant of the targets will use up all the ingredients of the reaction before the other target gets a chance to amplify. To avoid this, the primer concentrations for the more abundant target should be limited.

10. TaqMan Universal PCR master mix should be stored at 2 to 8° C. (not at −20° C.).

11. The GAPDH probe supplied with the TaqMan Gold RT-PCR kit is labeled with a JOE reporter dye, the same probe provided within the Pre-Developed TaqMan™ Assay Reagents (PDAR) kit is labeled with VIC. Primers for these human GAPDH assays are designed not to amplify genomic DNA.

12. The carryover prevention enzyme, AmpErase UNG, cannot be used with one-step RT-PCR which requires incubation at 48° C. but may be used with the EZ RT-PCR kit.

13. One-step RT-PCR can only be used for singleplex reactions, and the only choice for reverse transcription is the downstream primer (not random hexamers or oligo-dT).

14. It is ideal to run duplicates to control pipetting errors but this inevitably increases the cost.

15. If multiplexing, the spectral compensation option (in Advanced Options) should be checked before the run.

16. Normalization for the fluorescent fluctuation by using a passive reference (ROX) in the reaction and for the amount of cDNA/PCR efficiency by using an endogenous control (such as GAPDH, active reference) are different processes.

17. ABI 7700 can be used not only for quantitative RT-PCR but also end-point PCR. The latter includes presence/absence assays or allelic discrimination assays (such as SNP typing).

18. Shifting Rn values during the early cycles (cycle 0-5) of PCR means initial disequilibrium of the reaction components and does not affect the final results as long as the lower value of baseline range is reset.

19. If an abnormal amplification plot has been noted ($C_T$ value<15 cycles with amplification signal detected in early cycles), the upper value of the baseline range should be lowered and the samples should be diluted to increase the $C_T$ value (a high $C_T$ value may also be due to contamination).

20. A small ΔRn value (or greater than expected $C_T$ value) indicates either poor PCR efficiency or low copy number of the target.

21. A standard deviation>0.16 for $C_T$ value indicates inaccurate pipetting.

22. SYBR Green entry in the Pure Dye Setup should be abbreviated as "SYBR" in capitals. Any other abbreviation or lower case letters will cause problems.

23. The SDS software for ABI 7700 have conflicts with the Macintosh Operating System version 8.1. The data should not be analyzed on such computers.

24. The ABI 7700 should not be deactivated for extended periods of time. If it has ever been shutdown, it should be allowed to warm up for at least one hour before a run. Leaving the instrument on all times is recommended and is beneficial for the laser. If the machine has been switched on just before a run, an error box stating a firmware version conflict may appear. If this happens, choose the "Auto Download" option.

25. The ABI 7700 is only one of the real-time PCR systems available, others include systems from BioRad, Cepheid, Corbett Research, Roche and Stratagene.

Example 2

Identification of Diagnostic Marker Genes and Priority Ranking of Genes

For experimental groups, differences in gene expression between animals before and after experimental induction of endotoxaemia were analysed using the empirical Bayes approach of Lonnstedt and Speed (Lonnstedt and Speed, 2002, *Statistica Sinica* 12: 31-46).

The objectives were to: (a) identify changes in gene expression during the acute endotoxaemic phase of disease, and (b) evaluate the diagnostic potential of these changes, for detecting enodtoxaemia.

Comparison between dosed and control horses involved some information which is within horses (i.e. some information is available from the longitudinal comparison of horses which were used both as controls and as treated animals), and some information which is between horses (involving cross-sectional comparisons between horses which were dosed and horses which were not). In addition, some planed samples were not available. The result is an unbalanced, non-orthogonal mixed effects study.

Gene expression data were generated, and quality metrics were generated for each chip. Only chips providing high quality data and passing all quality metrics were used in subsequent analyses. The chips were then processed using the RMA (Robust Multichip Analysis) algorithm as implemented in the R Bioconductor project. Following calculation of expression measures, the distribution of the chips was compared using Box and Whisker plots, kernel density estimates and MA plots. Outliers were removed from further analyses.

Results obtained were corroborated using Microarray Analysis Software 5.0 (provided by Affymetrix) and a list of "housekeeping" genes to scale the data. Housekeeping genes were determined a priori by identifying those genes that vary the least in gene expression across healthy horses of various breed, age, sex, and geographical location, and across horses with various diseases.

Positive horses at each time point were compared with all horses at time zero, and negative horses at the time point concerned. For example, horses which were positive at 24 hours were compared with all horses at day 0, and negative horses at 24 hours. Two approaches were used for each comparison: univariate comparisons made gene at a time, and multivariate comparisons using the entire gene set. For the univariate comparisons, the analysis of each gene was made on a linear mixed model, in which horse was a random effect and time (time 0 vs current time) and status (control or induced) were fixed effects. Individual p values were adjusted using the Holm step down procedure (Holm, S. 1979, *Scandinavian Journal of Statistics* 6: 65-70) to provide strong control of the Family-Wise Error Rate (FWER). For multivariate analyses, a composite strategy was employed involving, reduced space linear discriminate analysis, support vector machines and classification tree techniques. Genes that showed statistically significant differences before and after experimental induction of endotoxaemia were tabulated for each day post dosing.

A list of genes ranked by p value for comparisons made between hours 0 and 24, 48 and 72 post-dosing is shown in Table 5. This analysis is based on two-group comparisons (Hour 0 versus hours 24, 48, and 72) with p Values adjusted using Holm's and the FDR method. Results are based on the full outcome from the empirical Bayes method.

Using linear mixed models, and at 24 hours, 159 genes were statistically significant when Holm's correction was applied and 995 genes following FDR adjustment. Using classification and regression trees, 829 of the 3105 genes on the GeneChip™ separated the groups perfectly with a p value of 0.002.

Using linear mixed models, and at 72 hours, no genes were statistically significant when Holm's correction was applied and 62 genes following FDR adjustment. Using classification and regression trees, 125 of the 3105 genes on the GeneChip™ separated the groups perfectly with a p value of 0.001.

Using linear mixed models, and at 120 hours, no genes were statistically significant when either Holm's correction or FDR adjustment were applied. Using classification and regression trees, 7 of the 3105 genes on the GeneChip™ separated the groups perfectly with a p value of 0.019.

The genes listed in Table 5 are ranked in order of their t statistic or value—which may be interpreted as a signal-to-noise ratio. The tabulation also displays the log 2 fold change (M value) and the adjusted p values. Genes with a negative t value (and hence a negative M value) are down regulated. Genes with positive t and M values are up-regulated. The priority ranking of significant genes ($p<0.05$) is based on increasing t value for the first time point (24 hours) followed by ranking on increasing t value at 72 hours. Note, some genes are significant for both 24 and 72 hours, others are significant for either 24 or 72 hours.

Example 3

Demonstration of Diagnostic Potential to Determine Endotoxaemia

In addition, the diagnostic potential of the entire set of genes was assessed using discriminant analysis (Venables and Ripley, 2002, Modern Applied Statistics in S, Springer) on the principal component scores (Jolliffe, I. T. Principal components analysis, Springer-Verlag, 1986) calculated from gene expression. The entire process was cross-validated. Sensitivity and specificity were calculated for a uniform prior. This may be interpreted as a form of shrinkage regularization, where the estimates are shrunken to lie in a reduced space.

Cross-validated discriminant function scores were used to estimate a receiver operator curve. The receiver operator curve was calculated by moving a critical threshold along the axis of the discriminant function scores. Both raw empirical ROCs were calculated, and smoothed ROCs using Lloyd's method (Lloyd, C. J. 1998, *Journal of the American Statistical Association* 93: 1356-1364). Curves were calculated for the comparison of clinically normal and clinically affected animals. Separate curves were calculated, using gene expression at each day post-inoculation. The area under the receiver operator curve was calculated by the trapezoidal rule, applied to both the empirical ROC and the smoothed ROC.

The ROC curve provides a useful summary of the diagnostic potential of an assay. A perfect diagnostic assay has an ROC curve which is a horizontal line passing through the point with sensitivity and specificity both equal to one. The area under the ROC curve for such a perfect diagnostic is 1. A useless diagnostic assay has a ROC curve which is given by a 45 degree line through the origin. The area for such an uninformative diagnostic is 0.5.

Figure 2:
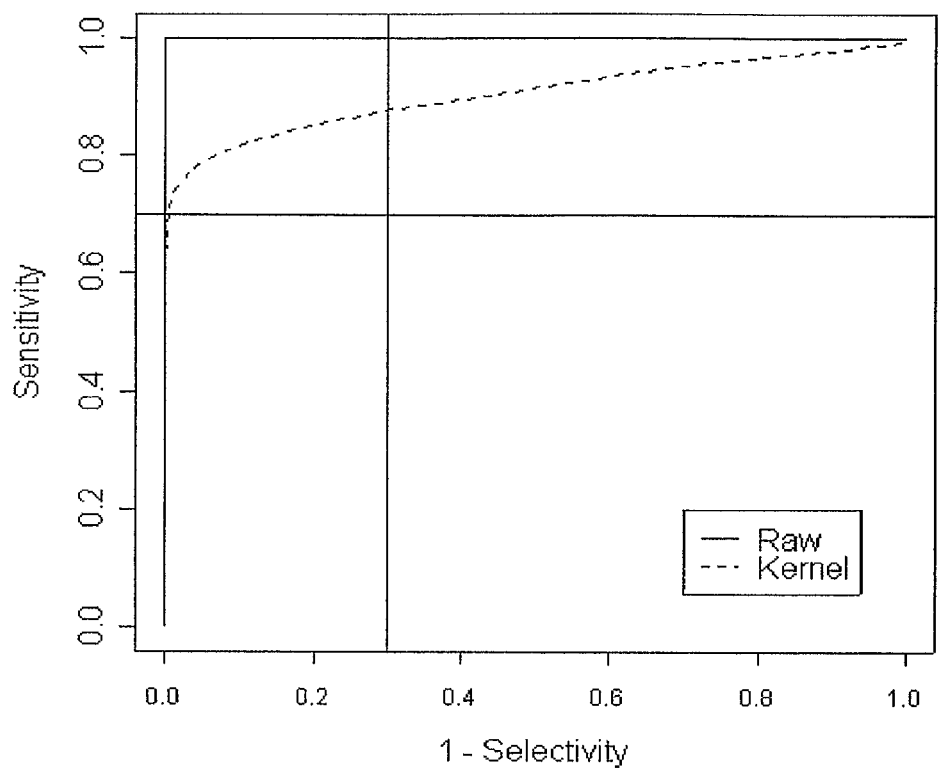
FIG. 2 is a graphical representation of ROC for comparison of gene expression 72 hours post-induction. The ROC curve generated from these data demonstrated that 72 hours post-induction, was well separated from 0 hours. The sensitivity and selectivity using two principal components are 0.667 and 1.00 respectively. Using four principal components this can be improved to 0.883 and 1 respectively (not shown).

The ROC curves for the analysis based on comparisons between time point 0 and time points 24 hours and 72 hours are presented FIGS. 1-2, respectively. The diagnostic capability is very high.

Example 4

Predictive Gene Sets

Although about 180 genes have been identified as having diagnostic potential, a much fewer number are generally required for acceptable diagnostic performance.

Table 6 shows the cross-validated classification success, sensitivity and specificity obtained from a linear discriminant analysis, based on two genes selected from the set of potential diagnostic genes. The pairs presented are those producing the highest prediction success, many other pairs of genes produce acceptable classification success. The identification of alternate pairs of genes would be readily apparent to those skilled in the art. Techniques for identifying pairs include (but are not limited to) forward variable selection (Venables W. N. and Ripley B. D. Modern Applied Statistics in S $4^{th}$ Edition 2002. Springer), best subsets selection, backwards elimination (Venables W. N. and Ripley B. D., 2002, supra), stepwise selection (Venables W. N. and Ripley B. D., 2002, supra) and stochastic variable elimination (Figueirodo M. A. Adeaptive Sparseness for Supervised Learning).

Table 7 shows the cross-validated classification success obtained from a linear discriminant analysis based on three genes selected from the diagnostic set. Only twenty sets of three genes are presented. It will be readily apparent to those of skill in the art that other suitable diagnostic selections based on three endotoxemia marker genes can be made.

Table 8 shows the cross-validated classification success obtained from a linear discriminant analysis based on four genes selected from the diagnostic set. Only twenty sets of four genes are presented. It will be readily apparent to practitioners in the art that other suitable diagnostic selections based on four endotoxemia marker genes can be made.

Table 9 shows the cross-validated classification success obtained from a linear discriminant analysis based on five genes selected from the diagnostic set. Only twenty sets of five genes are presented. It will be readily apparent to practitioners in the art that other suitable diagnostic selections based on five endotoxemia marker genes can be made.

Table 10 shows the cross-validated classification success obtained from a linear discriminant analysis based on six genes selected from the diagnostic set. Only twenty sets of six genes are presented. It will be readily apparent to practitioners in the art that other suitable diagnostic selections based on six endotoxemia marker genes can be made.

Table 11 shows the cross-validated classification success obtained from a linear discriminant analysis based on seven genes selected from the diagnostic set. Only twenty sets of seven genes are presented. It will be readily apparent to practitioners in the art that other suitable diagnostic selections based on seven endotoxemia marker genes can be made.

Table 12 shows the cross-validated classification success obtained from a linear discriminant analysis based on eight genes selected from the diagnostic set. Only twenty sets of eight genes are presented. It will be readily apparent to practitioners in the art that other suitable diagnostic selections based on eight endotoxemia marker genes can be made.

Table 13 shows the cross-validated classification success obtained from a linear discriminant analysis based on nine genes selected from the diagnostic set. Only twenty sets of nine genes are presented. It will be readily apparent to practitioners in the art that other suitable diagnostic selections based on nine endotoxemia marker genes can be made.

Table 14 shows the cross-validated classification success obtained from a linear discriminant analysis based on ten genes selected from the diagnostic set. Only twenty sets of ten genes are presented. It will be readily apparent to practitioners in the art that other suitable diagnostic selections based on ten endotoxemia marker genes can be made.

Table 15 shows the cross-validated classification success obtained from a linear discriminant analysis based on 12 genes selected from the diagnostic set. Only 20 sets of twenty genes are presented. It will be readily apparent to practitioners in the art that other suitable diagnostic selections based on twenty endotoxemia marker genes can be made.

Table 16 shows the cross-validated classification success obtained from a linear discriminant analysis based on 13 genes selected from the diagnostic set. Only 20 sets of twenty genes are presented. It will be readily apparent to practitioners in the art that other suitable diagnostic selections based on twenty endotoxemia marker genes can be made.

Further numbers of genes introduced noise (and subsequently lower specificity and sensitivity) through observational overload compared to the number of variables.

The genes listed in Table 5 are ranked in order of their t statistic—which may be interpreted as a signal-to-noise ratio. The tabulation also displays the log 2 fold change (M value), and the adjusted p values. Genes with a negative t value (and hence a negative M value) are down regulated.

Example 5

Demonstration of Specificity

The specificity of the endotoxemia signature was examined by training a classifier on the trial data only and running the classifier over a large gene expression dataset of over 850 GeneChips®. Gene expression results in the database were obtained from samples from horses with various diseases and conditions including; clinical, induced acute and chronic EPM, herpes virus infection, degenerative osteoarthritis, stress, *Rhodococcus* infection, endotoxemia, laminitis, gastric ulcer syndrome, animals in athletic training and clinically normal animals.

Three classifiers were generated. All were based on the comparison of positives at 24 hours with all horses at time zero, and negative horses at 24 hours. The first used all the genes on the GeneChip™. The second used only those genes that were statistically significant (Holm's adjusted p value<0.05). The third was based on all of the genes except for 45 that had been identified as being involved in at least one other gene signature for disease. The latter was the most specific. It was able to identify all eight endotoxemic horses in the database. It also identified five other horses, one with severe gastritis, one with botulism, another with Wobbler syndrome and two others with an unknown diagnosis.

Using this method and a gene signature of 159 genes, a specificity of 99% for endotoxemia was obtained from a population sample size of over 850.

Example 7

Gene Ontology

Gene sequences were compared against the GenBank database using the BLAST algorithm (Altschul, S. F., Gish, W., Miller, W., Myers, E. W. & Lipman, D. J. (1990) "Basic local alignment search tool." *J. Mol. Biol.* 215:403-410), and gene homology and gene ontology searches were performed in order to group genes based on function, metabolic processes or cellular component. Table 17 lists and groups the genes based on these criteria. See also Table 1, which contains sequence information for each gene.

The disclosure of every patent, patent application, and publication cited herein is hereby incorporated herein by reference in its entirety.

The citation of any reference herein should not be construed as an admission that such reference is available as "Prior Art" to the instant application.

Throughout the specification the aim has been to describe the preferred embodiments of the invention without limiting the invention to any one embodiment or specific collection of features. Those of skill in the art will therefore appreciate that, in light of the instant disclosure, various modifications and changes can be made in the particular embodiments exemplified without departing from the scope of the present invention. All such modifications and changes are intended to be included within the scope of the appended claims.

Lengthy table referenced here

US09816128-20171114-T00001

Please refer to the end of the specification for access instructions.

Lengthy table referenced here

US09816128-20171114-T00002

Please refer to the end of the specification for access instructions.

Lengthy table referenced here

US09816128-20171114-T00003

Please refer to the end of the specification for access instructions.

Lengthy table referenced here

US09816128-20171114-T00004

Please refer to the end of the specification for access instructions.

Lengthy table referenced here

US09816128-20171114-T00005

Please refer to the end of the specification for access instructions.

Lengthy table referenced here

US09816128-20171114-T00006

Please refer to the end of the specification for access instructions.

Lengthy table referenced here

US09816128-20171114-T00007

Please refer to the end of the specification for access instructions.

Lengthy table referenced here
US09816128-20171114-T00008

Please refer to the end of the specification for access instructions.

Lengthy table referenced here
US09816128-20171114-T00009

Please refer to the end of the specification for access instructions.

Lengthy table referenced here
US09816128-20171114-T00010

Please refer to the end of the specification for access instructions.

Lengthy table referenced here
US09816128-20171114-T00011

Please refer to the end of the specification for access instructions.

Lengthy table referenced here
US09816128-20171114-T00012

Please refer to the end of the specification for access instructions.

Lengthy table referenced here
US09816128-20171114-T00013

Please refer to the end of the specification for access instructions.

Lengthy table referenced here
US09816128-20171114-T00014

Please refer to the end of the specification for access instructions.

Lengthy table referenced here
US09816128-20171114-T00015

Please refer to the end of the specification for access instructions.

Lengthy table referenced here
US09816128-20171114-T00016

Please refer to the end of the specification for access instructions.

Lengthy table referenced here
US09816128-20171114-T00017

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US09816128B2). An electronic copy of the table will also be available from the USPTO upon request and payment of the fee set forth in 37 CFR 1.19(b)(3).

SEQUENCE LISTING (2317 sequences)

SEQ ID NO: 1 - DNA, 6218 bp, Homo sapiens
gcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttaactggcagtttgaactaactgtgttgagtcctaaacttagaagttgctgatacttacataacctaaccaaagagctatccagtagggttttagtttgtgaactttattttcctgttgattataaatcctgatttttaagatctatttacttgagcaaaatatgtttgatttcggttagttagacttaagatctcttattaaaagtccttactttctccaagcccagtcaatgttgacttctgggcaaacctgaaaatgccacttctttcatgcagattctttgaagttaagatggaatcttttcgagtgatagagctgcagagatatagaagctccatgggctgcccatctgtagatagctgtaaaatggaatatttttaattgaaggcaaaaaagtgcttaaaagtgagctgagcaataaaatggtccaataataggtaaatgcaacagaaacagaaggagacctggttgccttatacctttacgcgaacacggaataaactcccactgcacatcctgtctacaccataagtggagggaaataaacctcgtcatgctccatgctgtgaggctcctttggatattctgtgatgaccgagaagcctattttgttttgttttcaacatctttatccgaagtacgtttttaaagattttgtaagagtcgttttcagtgtttaaattagcgctatttttccttctttttaaaaatgaatcttgtactgtatcttactatgtctgtaacaggtgttaagaattgaaacagttttattcttagattcatgcgatccagtctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaagtcttttattagactaacattttttgagaagtaaaattgactttatatacaaagcctgtaattttaggcgaaatggaagcagaaatctaggaagttgtgcttgcttgtatggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattatcactgcatgaatctgattcagaggcatgcatttacatatgttgccctaattaccatttgatgatcataaatacaagtgaatgacattggacttttagtaacaaacttaatttttaaaaaagtgtagacaatggtggttaaaaaaaaaaaaaacaggtgccaggttctgtgtgtttgcaccaagtaattgacatgttttttgtttaatacatgtggaccatgaacagtattcattctactttttcaaatgatatgctgtagaaaatattccttgaagatgtgagatttaaaaatttttccctttcaatgttgttttaattgtatttcttacttggtttttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaattccttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactccttt

SEQ ID NO: 2 - DNA, 978 bp, Homo sapiens
  exon (1)..(978)
atggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtga

SEQ ID NO: 3 - DNA, 736 bp, Equus caballus
  oligonucleotide sequence
gactgggaacagcaagtgcaaagttcctgtggcagaaatgtgcctggcaaggaggcctgcatggctggagcattgtgagctggtgggagaatggagaacaggaagagatgatggggtacctcgcgtcttcatcggtaaagactgtataggtggatgcactgacctactcaacatgcatcagagtgggcagctgttgacacggctaaagcaaattggagctctagaataattacagagctgatcccagactgatgtccccctgagagctgaatagcattgcaatgatgacagcacttcctggtggatggatcaggggctacctttacccagctacagcagctgtttacttctgaaatatgttaaccaaaaaaggaggggtgggggttggcaaaaatagctttttcttttttgatttagtgttaaaagtggctcaacttgccccaaatcacagatctgagaaggttgatggatgtcttgggtttcttctggatcggccctttgggttccaaaagaccgtgacagtcatggcctagaattcactcactgactcaaaagatgttctctctctttggcacatgtttcttatgattgtcctccatgcgccgggcctcgtctacctctaagccagtgtttcgcaaccaagtttatcccaagcccctcaggatgaatctgtagttggttttctgctactacctgaaaattattttgttgagtttggctttatggagtttgtact

SEQ ID NO: 4 - DNA, 600 bp, Equus Caballus
  oligonucleotide sequence
gcatgtgtctccctggttaccatcctcactccaccccactcctatcttgagaatcgtttgctctgaaacagtgttctcaaccttgacaaattcacagctctcacaggaaatgttcaacagttaagaaattggagaagtgaattaagaaatgaagggcctgagggccccatttgagaaagtccgcaggaaacattaagcactgttggcctcctggtgcccagtgatcggaggtccaggtggagatgccgtgatcatctcttgcctaagatgctcatccaggtcatcctgaacaagtatgtgttaatttgcttagattatgaaccaaagtaaaacatgaaatttaaaacgttatcacagaaaacttacaactccctcccccaagggtatgtctgtgaaagtagccaaatttaagaaacacggtcctaaattattttctctctcctttttttccctactctctgaaaatttaaggatcccttactgtgatgtttgttctagcattgcaagagtaagttaatttccttctgcagtctttagggtgaatgttaatttcttttctaataaagaagtacccagagatgaaaaaaaaaaaaaaaaaaa

SEQ ID NO: 5 - DNA, 731 bp, Equus Caballus
  oligonucleotide sequence
ctttttcaaaataggtctctaaggaaaaccagcagaacattagcctgtgcagagccatcgtttggggagcacactcttccgttacgcttggcacgcagatctccctgtggtgggatttctttcttttttgttgtttttcctttttgtttcaagggggtacttcccccctattttctcttttcccttgatacaagttgtagatgaaataggagaaagcccttgttgctatagatgtgtgtgcagtctggcagccttaagcccacctgggcacttttagaaaaaaaacaaaaaacaccaaaaaaaacagtgtcatatgtattaatgatccaggtggtttttagtctttcctgatgatggggtgttcatgttagtttcttttcttgaaaaccctattcaacattaggcaaagtagctaagagccttttgttttggtaaattagtggggaaatggcattttaagaggactctcttctcaaagaacttagctgagagtcgaattcttctcttttccagctgatgaagctaagtgggtatcccagaaatgtttgttttctgaaggggagtactccaggccatcactgaagctgtgtccaggcagagagttagcacactttctacaccttgtagaattctgggctgtagcattactctgattttctgtctaatgaaggcagagagtgctggtagtttaaaatttttattttaggacttatctgtactctgaattttca

SEQ ID NO: 6 - DNA, 637 bp, Equus Caballus
  Oligonucleotide Sequence
taaatgaaaatctgtagattctctcctcccctaatcccagaaaacgaaaccaaataatgttttttgaaattgtttctaggatttcaaagtgaaaaatgatggtactatccaaaattctttatttcagaacatgacaatagattcctttaatgtaggctcaagatcaaaacagcatgtcctgtaagctcagatagactctgttgactccaagggttttgatcagtatcataacaaacttttccctttgacatgctctgatttttgttgtttggggggagggcgtgtgtgtgtgtgcgtgtgtgtgtgtgtgcgcgcgcgcgtgtgtgtgcggtgtccaccagtatcagtgcctgcctgcgttaggagaattacattcctggttctgtatgaggagaagggtgtataaagcaacatgaaacattacccctcattttgttttaaaggacaaactaatgttaattgttctcagaactggattttcttcctcaaaattaaaagttttcttttcttttggatttaatgaagtattgctagctgaagccagtttgacatggtgagagagatgtcagactgatgaaaggtgtgcagcctgatttaaaaccaaccccgaacccttttaaagaacataaaacatatt

SEQ ID NO: 7 - DNA, 4854 bp, Homo sapiens
  Oligonucleotide Sequence
  misc_feature (4407)..(4407): n is a, c, g, t or u
agcgggcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaaggaaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccgctctctccctatccatttgtaagaacaggctctcctcgccgaatacagttgtctcaaaatcatcctgtctacatttccccacataaaaatgaaacaatgctttctcctcgtgaaaagattttctactacttcagcaacagtccttcaaagagactaagagaaattaacagtatgatccggacaggagaaactccaaccaaaaagcgagggattcttttggaagacggaagtgaatcacctgcaaaaagaatttgcccagaaaatcattctgccttactgcgccgtctacaagatgtagctaatgaccgaggttcccactgaggttagtccatggtattgaaactgtcttctcacaaactctgtttagcagcatcatttaatgcatgctcgattatggggctctttcccttaatccttccagtatccataggatattctgactcatcccaactgccttttttcctaccattcagtgcttgccctcaaggctgcttagaatccaaacttggatttttgactctggcaaagcttttagaaatactgcaagaaaatgatgtgtacccaaacgtgagcataggaggcttctgttgacgtactccaacagaagaactgttttcaagttcattcctacccgttttgtggtcacctttggccctcacaaaaagtaaaacaaaaactaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgcgatggcactttctacaatgtgaactttattaagtataaaacttctaggctaaacattcaatatcttctttgatgcttttgtacttttttaaaattgttaaagccccagtagccaccttttgggcatatttgaaattctccagtttttgattattaagagggatcagctggctaagtaaagattttaaatcaagttgaattaaggggattaataggaaaattatgacctcttcctttaggaggcagttatccnaaagacatgtctattaaggtgatatattttaaaatatctttgagtgtgttcctggcagtttaagaaaatagttggagaatttaggtttttattagtacacagtaccatttatacaaattagaaaatgttatttaacagctattgaattatctatatacacctttattaatcgctattgttccagcagttttaacgttgaacgaataatcttattagggagaaaattcaattgtaaattgaatcagtataaacaaagttactaggtaacttcacattgctctgaaagaaatatggaacttacactgttcaattagaatagtgttctgcaaaaatatttataaaacctctcagatactgctactgtaattttatatgaaaataagtgtatttttcaataaagcatttataaattaaaaaaaaaaaaaaaaaaacaaaaaaaaaaaaaaa

SEQ ID NO: 8 - DNA, 3420 bp, Equus caballus
  Oligonucleotide Sequence
  exon (1)..(3420)
atgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaaggaaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccgctctctccctatccatttgtaagaacaggctctcctcgccgaatacagttgtctcaaaatcatcctgtctacatttccccacataaaaatgaaacaatgctttctcctcgtgaaaagattttctactacttcagcaacagtccttcaaagagactaagagaaattaacagtatgatccggacaggagaaactccaaccaaaaagcgagggattcttttggaagacggaagtgaatcacctgcaaaaagaatttgcccagaaaatcattctgccttactgcgccgtctacaagatgtagctaatgaccgaggttcccactga

SEQ ID NO: 9 - DNA, 894 bp, Equus caballus
  Oligonucleotide Sequence
  misc_feature (610)..(610): n is a, c, g, or t
ggacctttggcacaaacactgaaaagagttatgttgataatcagaagtgattgatggagcagaattccagcgtttcatggagagttgaagtacatgatgacaaaacccttgggaaaaccttctaatttcttgggacatttcaaggaagcaacatccccctttcttccaggaacttttttgtgacttgactaggactcgcactgctcccaaagttatcgccatcccaccttgctctccgtctcccataaaatcttgagggccacggagagaaggaggcgaattttaaatgtagatctcctcccttccacagccagtctcaaacacacctactcaaggtgtggtccatggaccagaagcatgagcatcattttgttagaaaagcagcatcaaaggtaccaccgcagatcttcggaaccagaacctgcattttaacaagatccccagggaatttgtgttgtacacaggagtgaatgttctggcatattctagagtattcttttgttttccatgctgacagaagagcttgtctttaaaactaggcaggaaaacatatcctcgactttgggactttgcatctgccattctctcttcctaggacaactttcctcanaatcggactaatttctaccctctcttcgagtctcagcatagtcatcaatttcaccaggaagcattctctgaatctcttgaagtaggattaggtgtcacctctgtgtgtcctctaaggcttcatgatttctagccttgtgtgatcatttcttctcttcttgagtgtctccaactggactgtgagctccataattacagggaatggcattcagttgattctccataaataagttgaatgaatgaatgaatgattactttccattttgaagatgaagaatttgaggc

SEQ ID NO: 10 - DNA, 569 bp, Equus caballus
  Oligonucleotide Sequence
accattcctgctctcactatggcttggccttgagacttgctttggctaatggaatgtcagcaagtgtgactcagacagagtgtgcattccttcttgcccgttacacgataagtctcgcttgttcttgcacccctgcctccgccatgagaatgtgcccaggctgaactgctggagggatgtgaaaaatgtatggaagacagttaagtcattccattataccagctgaggttgtccttaatcagccatcggaccaacttgtagctgactacagtcacatccatgagcccagtcaagatcagcagacctgcccgggcaacccagactcaggagccacaatcaagtaccattattttagggcacagagtttcaggagtggtttgttaacgaagtattcttggtggaagttgctaactgattcagcaaccaatggattgtcaatgttttgcatttgactgcaacaatttggaacatacaaagagggtgattcgcatcttcatttcctcttagctgtcaggatctgtaaatctaaaacgctttgaataaagttctttctgacagaaaaaaaaaaa

SEQ ID NO: 11 - DNA, 1604 bp, Homo sapiens
gagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttactcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcaaaattttgaagtctgtaaattgtgttagtcattaacttagtcacctgttgtattctggatctacacaaaattattttaagtgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattaaaaaaaaaaaaaaaaaa

SEQ ID NO: 12 - DNA, 555 bp, Homo sapiens
  exon (1)..(555)
atgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttactcgctctgctcctcccaaagcagttctccgacagaaatggatgaaaatgagtcatga

SEQ ID NO: 13 - DNA, 3623 bp, Homo sapiens
agcggaggggggagccggaagcccagcgcggagccggccgcggccccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggattaaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaagggtgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaagtgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtgtacatctacctactatgatctacaattttaggttaagtgaagcttgggggggctactgacttggttaccttcttgtctcttgtcccaaagatttaaactatgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattacttttaaagaaaaaaaaaaaaa

SEQ ID NO: 14 - DNA, 1983 bp, Homo sapiens
  exon (1)..(1983)
atgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 15 - DNA, 839 bp, Equus caballus
  Oligonucleotide Sequence
ggacgaaaaatttaccaaatttgcagatagcaagcctaggaggaatagctaattcacaggtgatagaattaagagtttaaaagattttttgacaaactggaatactatctggaaatgactaggatagaaatttgccaagaacaattgagtggttaggtttttaaaatattaatcaaagaatatctgttgtgtgctgagtacctgacatacattataggcagcatctcttgcaggattagtgatagcccagtttacagctggagaaattaaagtttggagaaataaggtaacttgtccaaagccagaatatagtaaatcgaaggtacaagtttaatatggagagtttctaacttgaaaagctttcgagtgaaaagaatctagacttcaccagtcagttgctcacaaagtcagtggaaaccaattagaaaagctggtagaaaagctaataaattatagactgtttgaacagttgtgtccagattgagggagataatagccctcccaccattctccatgcagatcataccaccccaaagtagctctttaatcagtaggtacaaaaatccattatcattatagtatatgcttaaaatatttttatgcacttagaaatgctaaaaatttagatatagcctaaagcaaataaaactttggctttttaaagattaaagtaggctagtctttttttaaaaaaaagtagaaaactagtatgctggcttgaaatatagagttatgtgtcatttcaagtattttaattgcaccttagtgaaattacatattttatgtagatttatttgagtactattgaatgtatttctttattacaatattactggaat

SEQ ID NO: 16 - DNA, 639 bp, Equus caballus
  Oligonucleotide Sequence
tttggagaaataaggtaacttgtccaaagccagaatatagtaaatcgaaggtacaagtttaatatggagagtttctaacttgaaaagctttcgagtgaaaagaatctagacttcaccagtcagttgctcacaaagtcagtggaaaccaattagaaaagctggtagaaaagctaataaattatagactgtttgaacagttgtgtccagattgagggagataatagccctcccaccattctccatgcagatcataccaccccaaagtagctctttaatcagtaggtacaaaaatccattatcattatagtatatgcttaaaatatttttatgcacttagaaatgctaaaaatttagatatagcctaaagcaaataaaactttggctttttaaagattaaagtaggctagtctttttttaaaaaaaagtagaaaactagtatgctggcttgaaatatagagttatgtgtcatttcaagtattttaattgcaccttagtgaaattacatattttatgtagatttatttgagtactattgaatgtatttctttattacaatattactggaatcctttacactgttacctgcttaggaataaataattctaaaagaaaatgtaaaaaaaaaaaaaaaaactcgag

SEQ ID NO: 17 - DNA, 820 bp, Equus caballus
  Oligonucleotide Sequence
gcgtaaagcatttttcttagcctttcctttgtcttgatctgttgttaacaagattaatactgccagacttaaaatattctactgttgggctaaaaggaatacaacttagattgcacaaaacttttgctttttagagaaaatataactcagctgtcttttaaaagagctgtgttgttatctacaagactatttgcagtctttttttcagagcagattctaacagttgtgaatggtttaaaaaatagaaaattactaaaatattagttttgggggttttatagagggagaaaaacaaaacaggaccaaagtttatgtgccttcttcagtagtcttaattgaccttttcttcctatttgagactgaggtagcgtcagtattctggttttcaggaaatatgtactatatagttttcgaagaatgttatcccacaggctgttcatagaagcaaagaactgtaactgtgtccatgaagtctcggttacacttttgcctttgtcacataatattcagtgtatagcatcgtgcaagtccaggacagagctgctctgaagctttgtggtagtcatcccagtttttgtaacctgaggcgtatgttccagagaacagggatatgtgtggtcccgtgaccttggtgatgatagtcatgattgcaagctctttatggcaagcttaaatcagcactgtaaacagatttttgttgtgttattttcggttctcgaatctatgtagtagttgtaataataaatatttaaatagctatttttgatgtcatttaaaaaaaaatcatcccctggcctttttccccctcttaccatgttac

SEQ ID NO: 18 - DNA, 666 bp, Equus caballus
  Oligonucleotide Sequence
cctggtctgccactgtcagcgtgaccttggcctcagttctcctagtctctaaggtcccttctaactttcatgtcagacaaggttcttttcatttgacattttgaaaggataatgagctttaaagtaagtcttggtaaggtgatattttaggcaatctttcttctccttatcgcttacagtgttcttagaattctttgaatatcatgagaacctcgtgtctgttctgattccctcctccttccctgatgctaaatttccaattgatatcaaactgtcaacctaccaaaagagatattgtggcttgtgggtattgctgtcttgtttttgatatgttcttgtattgactgcccattggcctgaaaatactcattgttaaacctaaaaaaaaaatcacttttctttcccactgactgttttttctgcttgttgtaagaatcaaacgagatattgtatgtgaaagcaccttgtaaactgtaacctatcaatgtaaactgttaaggtgtgttgttatttcattaattacttctttgttcagaatgaaatttcctacgcactactgtagctaggaaatgctgaaaacaactgtgttttttaattaatcataactgcaaattaaagtatcttcaaaggatagaaaaaaaataaaaaaaaaaaaaaaaaaaaaac

SEQ ID NO: 19 - DNA, 2473 bp, Homo sapiens
caagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaaaaaaaaaaaaaaa

SEQ ID NO: 20 - DNA, 1437 bp, Homo sapiens
  exon (1)..(1437)
atggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctga

SEQ ID NO: 21 - DNA, 1969 bp, Homo sapiens
gggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatgtaaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaaacacaaggagaagacaaaaatattgtaagtctcaagaatttctgaatgaacgaaaaagttctccacaaaaatctagtggcatacaattcccaaattcattttatgaaacccatccagattttaccagtgaagatatattcaacaagtcaagatctccaacttggtatacatatgcttctacgcctggtatggaggtcacagacttagaaagttctacaggattttggcttactcagtttgctcttagtgaagagacaaaggcagatgtgtattattatggcttcatcattctttttcttttggtattagtatgtcttgctttatattttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22 - DNA, 1521 bp, Homo sapiens
  exon (1)..(1521)
atgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatgtaaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaaacacaaggagaagacaaaaatattgtaagtctcaagaatttctgaatgaacgaaaaagttctccacaaaaatctagtggcatacaattcccaaattcattttatgaaacccatccagattttaccagtgaagatatattcaacaagtcaagatctccaacttggtatacatatgcttctacgcctggtatggaggtcacagacttagaaagttctacaggattttggcttactcagtttgctcttagtgaagagacaaaggcagatgtgtattattatggcttcatcattctttttcttttggtattagtatgtcttgctttatattttctctga

SEQ ID NO: 23 - DNA, 1426 bp, Homo sapiens
  Oligonucleotide Sequence
ggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgaacttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacacgggcggggacaataagggaataaaagctggcgagcgcggcaccccaccagagtctgcttccacgttgtgggagctttgttctcttgctctacacaataaatcttgctgctgcttaaaaaaaaaaaaaaaaaaaaaaaaaaaaaaaaaaaa

SEQ ID NO: 24 - DNA, 792 bp, Homo sapiens
  Oligonucleotide Sequence
  exon (1)..(792)
atggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaagttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgaacttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctga

SEQ ID NO: 25 - DNA, 913 bp, Equus caballus
  Oligonucleotide Sequence
gtttcatccgttctgtgaggctctgcggcatctgccagatagcaaacaggcctcatgcaggcagattagggcctaaagcagatcagaaggctttgtaaaagacctccctgagccatccctctgcagtgttggctcaaggccacatgtcgtttagtcacagcaaagagtagacagttaggaaaagcaaatgtctttttattttctaacatctcctcccctcagataggggagctatgactcagttgcacctaagaatactgtaatttgactctgtaattgcctttgcttcccaaacctgggaatcaatggaaaggcagggaatgttcctcttctgtggccaggttctgttctttgcaattacagcaaatttttaaaaatgcaaaggcagttgttggtccgcagggcttggccagttatgtggtagatacagaggctagcagacaatttgaggatcccgctgtaataataaatggcagctagcattcgttgaccatgtatttatatgtcaggcactgagctaggcaggctctctctatatggcagctccaaacttcacaataactgtgagttaagtactttatcttcatttcatagatgaagaaacaggttcggagagaaaaagttctttcccaagccagtacagctagtaagtggtagaatcaggattcatagtgtcaccatatgggaccaatgtttatagggaaaaggaaaattacaagtcttcttaaaatgaagtggccagcttttcttgcacagactaaataactctaactggcatttttcggttgggaaacagctgaattagtagttaagtctgacagccaagtgagttttagaaaccgcagcgtggagcatgcactcccccacaccatctgctgtgttgattagcagtcctgcctcagtctctttcttt

SEQ ID NO: 26 - DNA, 721 bp, Equus caballus
  Oligonucleotide Sequence
aagaagaaatagataatctgaatagcgctatgtctattaaaacttaatagctctggggggtgtaggtattattgtcctcattttacagataaggaaactgaggctcagagagagaaagtctgttgctcaaggtagcaaagctaaaatatggcagagctaggattcaaatccaggtcttctgattctcattccagtgccctttcagtataccgtgttgcctctaaagattgcagctccttatttactggaaagttgttcctgcccagtccacaccctcccaccccatcttcctcgagccctctgtctgtgttttcatcaggattatattcattgtatttggaatccgtgttcttttttgtgttgggaaaaacaaatctcttctaccagcttgcactcagaccaacttggaaaaaaaaagtttaaatgctgttgcagatgtacaacttaaaaatgtgaagtttgtagctttaacttttgtaactaaaattaataacactggcttaagtgctgactagaaatgctattttataaagtttggatgtaaataatcagtcgaggtcagcagtttgtatatgtatgagacagcttcctccattgcctttttttttaaatttgaaatgctttctctgtgctttcgttagaattgttgttcttcctctttcctacaccgtgtcacctttgttttaaataaactgtccttcggaaaaaaaaaaaaaaaaaa

SEQ ID NO: 27 - DNA, 1793 bp, Homo sapiens
agtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggctagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgaaaaaaaaaaaaaaaaaa

SEQ ID NO: 28 - DNA, 1305 bp, Homo sapiens
  exon (1)..(1305)
atgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggctagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaa

SEQ ID NO: 29 - DNA, 2223 bp, Homo sapiens
gctcgccagggaagggccctacccagaggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaactcaatttcatttctctgttctggccatccttgccaaatggtatacaggcggcttatgaggattttgacagggacctaattttcctatttaaaggcaaccaatactgggctctgaatggctatgacattcagcaaggttatcccaaggacatatcaaactacggcttcccaagcagtgtccaagcaattgatgcagctgtttcctataggagtaaaacatacttctttgtaaatgatcaattctggagatatgataaccaaagacgatccatggaagcaggttatccccaaagcatagcaagtacctttccaggaataggaagcagaattgatgcagttttccagcaagatgacttctttcttttcttcagcggaccagtttattatgcatttgatcttaatactcagagagttactagggttgcaagaatcaataaatggcttaactgtagacgaagttgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatctgctacatgcaatttagcactggatttaggttataagtaaggattataaacaagatagatagtactccttgcgtttattgaaaatctggtgctattttccactcttggaaagaaatattgttgatatgtattgtgagttgaattgtgttccccaaaaaagctatgtgcaagtcccaacctcgggtacctatgaatgtgagcttaccagggtctttgcagatgtaaatagttaagttaaggtgagatcacactgaattagggtgggctctaaatccattatgactgttgttcttataagaagaagagagcatagccacctaggggaggaggccgtgtgaagacagaggcagagattggagtgacgcatctccaagccaa

SEQ ID NO: 30 - DNA, 1404 bp, Homo sapiens
  exon (1)..(1404)
atgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaactcaatttcatttctctgttctggccatccttgccaaatggtatacaggcggcttatgaggattttgacagggacctaattttcctatttaaaggcaaccaatactgggctctgaatggctatgacattcagcaaggttatcccaaggacatatcaaactacggcttcccaagcagtgtccaagcaattgatgcagctgtttcctataggagtaaaacatacttctttgtaaatgatcaattctggagatatgataaccaaagacgatccatggaagcaggttatccccaaagcatagcaagtacctttccaggaataggaagcagaattgatgcagttttccagcaagatgacttctttcttttcttcagcggaccagtttattatgcatttgatcttaatactcagagagttactagggttgcaagaatcaataaatggcttaactgtagacgaagttga

SEQ ID NO: 31 - DNA, 2550 bp, Homo sapiens
agtttaattacgtccccgggaactgcgccgatttggacttttggcacttggacctatgctttaaaaagaaaaaagtgtcattggcgtggagtggggctagtggagggtgaggtgaatgcgccgtttggaaaccacaggacagtgaacgtttcgtctctcccagcgagactctcccgcgggcccggcggccgcatcgggagcccggcggaaacatggcggcgcccggaggccggggccgcagcctctccggcctgctccccgcgcagacctcgctagagtacgccctgctcgacgccgttacccagcaggagaaggacagcctggtctaccagtatctgcagaaggtggacggctgggagcaggacttgtcagtacccgagtttccggaaggattagaatggctgaacacagaagaacctatttctgtctacaaggatctatgtggaaaaatagtcgtccttgatttcttcacctactgctgcataaactgtattcacctattgcctgatctccatgcattagaacacacatactctgataaagatggtcttcttattattggtgttcactcggctaagtttccaaatgaaaaagtcctggataacattaagagtgctgttcttcgatacaacatcacccaccctatggttaatgatgcagatgccagcctttggcaagaactagaagtttcctgctggccaactctagtcatacttggacctcgtggaaacatgttgttttctttgattggagagggacacaaagataaattatttttatatacttcaattgctttaaagtattacaaagacagggggcagatcagagataataaaattggaataaaactctataaagattctttgccaccttcaccattgctatttcctggcaaagtaacagtagaccaagttactgatagattggtaatagcagacactggacatcatagaattttggtcgtttggaagaatggacaaattcaatatagcattggaggacccaaccctggaagaaaagatggaatattttcagaatcaacttttaattctccacagggtgtagccataatgaataatatcatatatgtggcagacactgaaaaccaccttataagaaagattgacctagaagctgagaaggtgagcactgtagctggtattggaattcaaggtacagataaagaaggtggagcaaaaggagaacagcagcccattagttccccttgggatgtggtttttggaacatcaggttcagaggtccaacgagatgacattctgtggatagccatggcagggactcatcagatatgggcactcctgttggactctggcagactaccaaagaaaaatgagttaaaaaaaggaacctgccttcagtttgctggaagtggaaatgaagagaatcgaaataatgcatatcctcacaaggcaggttttgcccaaccttcaggtctttctgtggcctcagaagatccctggagctgcctgttcgtagcagatagtgagagcagcaccgtgagaaccgtctcactgaaggatggagccgtgaagcaccttgtgggaggagaaagagaccccatggacttatttgcttttggtgatgttgatggagtaggaatcaatgcaaagcttcagcacccacttggagtaacttgggacaagaaaaggaatttagtttatgtggcagactcttataatcacaagattaaagttgtggatcccaaaacgaaaacctgtacaacattagcaggaactggagatgcaagtaatgttatcagttccagttttactcagtcaacttttaatgagccaggaggcttgtgtattggagagaatggtcagttattatatgtagcagacaccaataatcatcagattaaagtgatggatttagaaacaaaaatgatttctgtgctcccactcttcacatctgaaaacactgtggtagatggcccattcccagaagaaaaacagaagacattacccagactacctaaatctgctccagccgttaaactctccccagtggctgcatctccaggacagactcttcagttcaagctgagattagacctcccatcgggagcaaaactaactgaaggagcacccagttgctggtttctaacagctgaaggcaatgaatggcttcttcaaggacagataccatctggagaaatagagagcatttccaatcaacccacaatctcactacagattcctggagattgtgtatcgcttgaagctgttatatctgtcagcgtgtttctttactactgtagcgcagacagcagtgcctgtatgatgaagggaattttgttcagtcagcctttacaaataagcgctacgcaacaaggttgcatagctccagtagagctccaatatgtattttagcaagcaagctagctagcaacccattgccaccacctactgtctcccatcctgactatcactgtaatttaaggaaagaaaactttatttctgcctctggataccaagaaacccattgctgagttctagccactgatcttaaaataaagctatgctcctt

SEQ ID NO: 32 - DNA, 2181 bp, Homo sapiens
  exon (1)..(2181)
atggcggcgcccggaggccggggccgcagcctctccggcctgctccccgcgcagacctcgctagagtacgccctgctcgacgccgttacccagcaggagaaggacagcctggtctaccagtatctgcagaaggtggacggctgggagcaggacttgtcagtacccgagtttccggaaggattagaatggctgaacacagaagaacctatttctgtctacaaggatctatgtggaaaaatagtcgtccttgatttcttcacctactgctgcataaactgtattcacctattgcctgatctccatgcattagaacacacatactctgataaagatggtcttcttattattggtgttcactcggctaagtttccaaatgaaaaagtcctggataacattaagagtgctgttcttcgatacaacatcacccaccctatggttaatgatgcagatgccagcctttggcaagaactagaagtttcctgctggccaactctagtcatacttggacctcgtggaaacatgttgttttctttgattggagagggacacaaagataaattatttttatatacttcaattgctttaaagtattacaaagacagggggcagatcagagataataaaattggaataaaactctataaagattctttgccaccttcaccattgctatttcctggcaaagtaacagtagaccaagttactgatagattggtaatagcagacactggacatcatagaattttggtcgtttggaagaatggacaaattcaatatagcattggaggacccaaccctggaagaaaagatggaatattttcagaatcaacttttaattctccacagggtgtagccataatgaataatatcatatatgtggcagacactgaaaaccaccttataagaaagattgacctagaagctgagaaggtgagcactgtagctggtattggaattcaaggtacagataaagaaggtggagcaaaaggagaacagcagcccattagttccccttgggatgtggtttttggaacatcaggttcagaggtccaacgagatgacattctgtggatagccatggcagggactcatcagatatgggcactcctgttggactctggcagactaccaaagaaaaatgagttaaaaaaaggaacctgccttcagtttgctggaagtggaaatgaagagaatcgaaataatgcatatcctcacaaggcaggttttgcccaaccttcaggtctttctgtggcctcagaagatccctggagctgcctgttcgtagcagatagtgagagcagcaccgtgagaaccgtctcactgaaggatggagccgtgaagcaccttgtgggaggagaaagagaccccatggacttatttgcttttggtgatgttgatggagtaggaatcaatgcaaagcttcagcacccacttggagtaacttgggacaagaaaaggaatttagtttatgtggcagactcttataatcacaagattaaagttgtggatcccaaaacgaaaacctgtacaacattagcaggaactggagatgcaagtaatgttatcagttccagttttactcagtcaacttttaatgagccaggaggcttgtgtattggagagaatggtcagttattatatgtagcagacaccaataatcatcagattaaagtgatggatttagaaacaaaaatgatttctgtgctcccactcttcacatctgaaaacactgtggtagatggcccattcccagaagaaaaacagaagacattacccagactacctaaatctgctccagccgttaaactctccccagtggctgcatctccaggacagactcttcagttcaagctgagattagacctcccatcgggagcaaaactaactgaaggagcacccagttgctggtttctaacagctgaaggcaatgaatggcttcttcaaggacagataccatctggagaaatagagagcatttccaatcaacccacaatctcactacagattcctggagattgtgtatcgcttgaagctgttatatctgtcagcgtgtttctttactactgtagcgcagacagcagtgcctgtatgatgaagggaattttgttcagtcagcctttacaaataagcgctacgcaacaaggttgcatagctccagtagagctccaatatgtattttag

SEQ ID NO: 33 - DNA, 2078 bp, Homo sapiens
catcaccctttttaacattgtttacacatcactgcctgttttagccatggggatttttgaccaggatgtgagtgaccagaacagcgtggactgtccccagctctacaaaccaggacagctgaatctgctttttaacaagcgtaaattttccatttgcgtgttgcatggaatctacacctcattagtccttttcttcatcccctatggggccttttacaacgtggctggagaagatgggcaacatattgctgactaccagtcctctgcagttacatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagatggtcactgtcgaattcgtgatttggtggacaaaacactcgctgttacaagtacagattttttttttttttaaatcaacctagataccaatggacctgaacttcagaatcttatttatggagaaaaacttgtaagtctgcatatacattgaatgaatcttcagatggataaaacggtgcaatcaaaaggtaatcaaaatatcccagctgaagagtgtgcttgttgacagataaacacgtataggtaagctcagcctttcccaggatatgcttttaagatttaaaatgcgtcctaaggtgctttcagactaagagcagcttgtcactttccagtcttgatatctacctgtgtgttcaactgagacaacacatccccttccggcctgaagagtagaggaatgtgttggtgttcctcatttttctactagtttagagatgaagtagagtgagcatctttacagtgggatgggctggtaatgtggtcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaaccagcaaagcactggaatttcaccctttaatgattgtttttcatatagtatatgggcaaataccttccaagtttccaattttaaaaagttcagatttgaaaccaaacagattaataaacaatctctttcattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgaaaaaaaaaaaaaaaaaa

SEQ ID NO: 34 - DNA, 588 bp, Homo sapiens
  exon (1)..(588)
atggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtga

SEQ ID NO: 35 - DNA, 3651 bp, Homo sapiens
agcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgtgagtgtggtgtctgtaagtgtacagatccgaagtttcaagggcaaacgtgtgagatgtgtcagacctgccttggtgtctgtgctgagcataaagaatgtgttcagtgcagagcctttaataaaggagaaaagaaagacacatgcgcccaggaatgttcacatttcaacattaccaaggttgaaaatcgggacaagttacctcagccaggccaggttgatcccctgtctcactgtaaggagaaggatgtggatgactgctggttctatttcacgtattcagtgaatgggaacaatgaggccattgttcacgttgtggagactccagagtgccccactggtccagacatcattccaattgtagctggtgtggttgctggaattgttcttattggccttgcattgctgctgatttggaagcttttaatgataattcatgacagaagggaatttgccaaatttgagaaggaaaaaatgaatgccaaatgggacacgggtgaaaatcctatttataagagtgctgtgacaactgttgtcaatccgaagtacgagggaaaatgagcactcgctgtgcaaatttcacaacactgaatgcaaagcagtacttttcctagtcacagtaaggtagctgtagggctgtaccgccatggggttactcatgtgccggttttgaaagtgtacaatatgtataattttaaaaatttgttattattttgaaaataatgttatcatcaatgccagggactgaccagagacttgagacaggatggttgtcctcatcataaggtcacgtggtgcctttttgaccttttactcctgggctgttgaaatcaagttcttattggatcgagtggtgtgtctacagtgatggaagggcagtagttaaaataatgagtatgatgagagtttctattaatcacgtattaaaactgatctttagctttacagatatgtcagttttcagttatacagaatccacagtaaatttctgctacctagtttagaattgttttaaatctgttattttgctatttgcctgttagacatgactgatgacatatctgaaagacaagtatgttgagagttgctggtgtaaaatacgtttgaaatagttgatctacagaggccatgggacaaagtcagagagttagaaagggaaaccatagctttaaaacctgtgtgccattttgagagttacttaatcttggtaacttttatgccttctttttataaattcaagccttcaggaaaagtattgggaaattttctgcaaaaaagtccttgatttagcattatttacataaaggccttaatttccatagtacttgctgaattggggacctttgggtgaatttgttttattcattttattttgtttgaagcctggtgctttttaccacctcttctaatcatttaatgtatttgtttgcaatttgggggtaagactttttttatgagtactttttctttgaagttttagcggtcaatttgcctttttaatgaacgtgtgaagttgtactgtggcttacgcaacagctgtcacttaagcgactcttattttcaggcagtgccgtaatagaccgctgtatagttacttctcactgtcagagctgcccattttgtttcataccagtcacatccttgttttaagtgccttttaattttaacagttcactttttacatgctgtttactgaagttatttattaaatatgcctaaaatacttaaatcggaaaaaaaaaaaaaaaaa

SEQ ID NO: 36 - DNA, 2397 bp, Homo sapiens
  exon (1)..(2397)
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgtgagtgtggtgtctgtaagtgtacagatccgaagtttcaagggcaaacgtgtgagatgtgtcagacctgccttggtgtctgtgctgagcataaagaatgtgttcagtgcagagcctttaataaaggagaaaagaaagacacatgcgcccaggaatgttcacatttcaacattaccaaggttgaaaatcgggacaagttacctcagccaggccaggttgatcccctgtctcactgtaaggagaaggatgtggatgactgctggttctatttcacgtattcagtgaatgggaacaatgaggccattgttcacgttgtggagactccagagtgccccactggtccagacatcattccaattgtagctggtgtggttgctggaattgttcttattggccttgcattgctgctgatttggaagcttttaatgataattcatgacagaagggaatttgccaaatttgagaaggaaaaaatgaatgccaaatgggacacgggtgaaaatcctatttataagagtgctgtgacaactgttgtcaatccgaagtacgagggaaaatga

SEQ ID NO: 37 - DNA, 872 bp, Equus caballus
  Oligonucleotide Sequence
atcctcgtgccgggagtgcagatcctttgaaccattgttatggtaggacaggccccttcaacggcctggggagctggaataagctggcttactgtttggaatcgtgctggtgggtcagatgtctctagttctagtaaaaagcaactggagtctcctgggagaaacttcgggaagcagagttgtgttaggtaaggctctgctgacattgcacagttttagacgaacgttggcacaggatgttagatttctgtgacaagttcatctacctattttagtaagcacatagttctccagctaaaatttgaattcttcttgaaataaaagaagatgaaatgaaagaataattcttgaaatatcactcaaatacccccagcatgttgtgagcttcctgtaagtggtgggttacaaatctgctgggtgccaagtgctggatagtgctgggtggctgtgtaggaacccccttggcttgcgtgtgaaggcttgcagattgccaggaggctccagctaatgagttttaggtagagcctggaaagctgtgtgttaaacttctttccaaggaattctggtcaccaggcggcttgggaacgatgagggcaggccacataggatatgttaggcaggaaagaaacacccttttaaaagacaagggtagaagaggagtgaaatacttggaactcagaactagcaagagagttgacagatttcctatgatctttggaaactgtcttcactgatgaaagtacaccgcttttgtagactatctgattagagggcattgtgctgcttttgtgaagggaaagtggccgtggtggtggagatgtcaaagacttggacaagggagcaggggctgcctaatttcaaagtctggtttt

SEQ ID NO: 38 - DNA, 729 bp, Equus caballus
  Oligonucleotide Sequence
  misc_feature (232)..(232): n is a, c, g, or t
acttgtagtggtgacagtttagagagtctaaaactctgtaaggttgtaaaggaggcgtgacaaaaccagctggagtcaggaactgcttccactctgctcatgcaacagccgagttaagaaataagtgttccccagaatgcacactgtgctgccacccccaggtgacattctttccaggtacatttgacacctcttctcgcacatcctgttcacctgttggtgaccacacccntggtctcatgcgagatttagtacacctgcacagtcccttctcaggggcagacctcctcctgacggcctccgccagtgagttgcagccacccgatgttgcgtttggaagtgtttgttgctcccgttggagaaagtatttgcataagcatttcatgtgtctagtgtggcatttctggatgcggctgtcacagcagtgttattggtagttaatcttactgcaaggtgaacagtatggctgtttgctttgtccttgccatggcgttcttagaaagtaccctgtctttcaatattggttttttcaacatgaatatattctacttacaaactcgttttgcttctttgtatataatttgccttgggtttattgtgcacagtttatttagttatgttttcgtgtattatcaggagcaatttgataagtacatgtgaataacctcctgtaaatgaattttataacaaaatgtactaaaatattttctcaaaaaaaaaaaaaaaaaa

SEQ ID NO: 39 - DNA, 3876 bp, Homo sapiens
ggggaagggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagaacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtccggtctcagcgggtaaggtcattacttggactatctaattcagaaccaaatggatcagtagaaacaaagaatttagaacagatcctgaatggaggtgaatctcctaagcaaaagggacaagaaataaaaaggccctctggtgatgttcttgagacattcaatttcttagaaaatgctgatgacagtgatgaagaagaggaaaatgacatgattgaaggcatcccagaaggaaaggacaaacatcggatgaataaacacaaaataggtaatgaaggtttagctgctgacctaactgatgatcctgatactgaagaagcacttaaagagtttgattttttagtcactgctgaagatggtgaaggagctggagaagcacggagttcaggggatggcacagaatgggctgaaccaataacgtttccatctggaggaggcaagtcatttattatgggttctgatgatgttttgttaagtgtactgggccttggagaccttgcagacttgacggtaacaaatgatgcagactatagttatgatttgcctgccaataaagatgcctttcgaaagacatggaaccccaagtatacactacgtagccattttgatggagtacgggcattagctttccatcctgtagaacctgtgctggttactgcctctgaggaccatactctgaaactttggaacttgcaaaaaacagttcctgccaaaaagagtgcctctttggatgtagagcctatctacacatttagggcccacattggtcctgttctatcattagctcttagttctaatggagaacaatgttttagtggtggtattgatgcaaccatccagtggtggaatatgcctagccctaacgtggatccatatgacacatatgagccaaatgttctagctggcactttagttgctcatacagatgctgtctggggtcttgcttatagtggcataaaaaatcagttactgtcttgttcagcagatggcactgttaggttatggaatccgcaagaaaaattgccgtgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctattaaatgtctggaagccatgattgttctattagattgtggaatttggacagcaagacatgtgtgcaagaaataacagcacataggaagaaattagatgaatcaatttatgatgttgctttccatccatcaaaagcatatattgccagtgcaggggctgatgccctggccaaagtgtttgtgtgaatcaacagaagctcacattctaacagcagacttgcgtggacagaaagagggtctgcatcactgccatcagaaagcttcctgatatgacactacatgtgatctgcctggtgaaggctattgaggacaggcataaattggtagaaatcacatcttaatgtcaggctcattaatttaattgtaattactgtattttgtgggacaaaaaaaaggactccagtatttgtggcctgtactggatatgaactgagcgtatgtctgttttttaggtatctttaagccaatgtggagtctgaccttacaaaaaagttttttttttctcttcttcttcttctttttttttttttttttttttttattttggactctgtgtgctgccttagggttaggaatgtggtgctcttgttggggggaagtgagctccaagagtagctttttttcatctcttagtgatcttctgtttatcagttgaatgccacagattcccttttaaacttattttgctttaaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtattcacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaatttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgta

SEQ ID NO: 40 - DNA, 1962 bp, Homo sapiens
  exon (1)..(1962)
atggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagaacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtccggtctcagcgggtaaggtcattacttggactatctaattcagaaccaaatggatcagtagaaacaaagaatttagaacagatcctgaatggaggtgaatctcctaagcaaaagggacaagaaataaaaaggccctctggtgatgttcttgagacattcaatttcttagaaaatgctgatgacagtgatgaagaagaggaaaatgacatgattgaaggcatcccagaaggaaaggacaaacatcggatgaataaacacaaaataggtaatgaaggtttagctgctgacctaactgatgatcctgatactgaagaagcacttaaagagtttgattttttagtcactgctgaagatggtgaaggagctggagaagcacggagttcaggggatggcacagaatgggctgaaccaataacgtttccatctggaggaggcaagtcatttattatgggttctgatgatgttttgttaagtgtactgggccttggagaccttgcagacttgacggtaacaaatgatgcagactatagttatgatttgcctgccaataaagatgcctttcgaaagacatggaaccccaagtatacactacgtagccattttgatggagtacgggcattagctttccatcctgtagaacctgtgctggttactgcctctgaggaccatactctgaaactttggaacttgcaaaaaacagttcctgccaaaaagagtgcctctttggatgtagagcctatctacacatttagggcccacattggtcctgttctatcattagctcttagttctaatggagaacaatgttttagtggtggtattgatgcaaccatccagtggtggaatatgcctagccctaacgtggatccatatgacacatatgagccaaatgttctagctggcactttagttgctcatacagatgctgtctggggtcttgcttatagtggcataaaaaatcagttactgtcttgttcagcagatggcactgttaggttatggaatccgcaagaaaaattgccgtgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctattaa

SEQ ID NO: 41 - DNA, 786 bp, Equus caballus
  Oligonucleotide Sequence
ggccgccgccactgttgggctctcctttcagtcgtcatttttaaggaaagaagggtactatgtttattgttaaaatttcacagaaaatttttgtctgatgaatttattagtcttcattttgagggtaaaagaattttagaaaatgcaaatattctgtaaaaaatttagatttttgatattttgggaaaagttgatgaaagcaacctcagataaaaattttctgaaaaccatcaatgtggtcacgatacagacttcagtgtgctgttcctggtcgcgggtgtaacggaggaggggttccaacgcagtttgtgccgggaaatccgagtgcgcgcccaaaggagaggttggccgcggtggcggcagcagcacctccctgcacctcacttcttaaagccaagattagttttatgccctcctcctttctggggtatttgactttctagttcatgatagaaaatcctctttgctttgccagtcgatcccacttggttagatgacttggtaagggggatggatgtccaggagtaaatgaaccttgactgtgtcttacacttgcaatgatatttataatttgggtcattaaaaacattttaattagtggccagaatataaaacttccttttctcttgggaaaagtcttgtagccactgggagttgggcaggtagtcacacggaactcagcagcagtcactagatgttcttccttctcaccagtgcttgagctttcacagtggacttgattgagttgtcaatttagtggtaataaatgagctgtacgttggtccc

SEQ ID NO: 42 - DNA, 696 bp, Equus caballus
  Oligonucleotide Sequence
gtgacttgagcacggtttagtttagtcttcaccttggctgtcaccttccagagggtgtgtgcacagaccctggggcacacacagcactgagcaccacgaggatgcccaagaccgagcaacagcaagggctggtttcctcccggtgttacaaaccacacaagcagacgtctctgagcgtttccagtgttttatccaaataaaaactctactagggctcttgctgacttcagtgccttttgtaaatcatttttgattttcctcaacttgctttttgggaataggcagtgatgctaagtggaggtaagtgagattctttctcctcgttaagttttgttcttaaaacttctacattgaaacttgtatttaaaatagcttatttctttcacgtgataacaagacaggtcaggaatatggaatcaagatttagattttaaaattcaaaaggttgttacacagggtgtttccacttgtgtagcagtggaatctagatataagacagaaaaacacattctcttctaaagaccaacggcatttttaaaaggcatctttgttctcaacagaaatcggaatacagatgttatattcacagtcataacctgtttcctctaagatcttgctatactgtcctgtatattgttgtaaatattcagatggaaattaaaatggtgtttttgccctaaaaaaaaaaaaaaaaaa

SEQ ID NO: 43 - DNA, 898 bp, Equus caballus
  Oligonucleotide Sequence
ggaagctttgaactgtgctgactcttctgtttggggaaggaggttgttttctgtgtgcctcagaatatgacggctgccaaaccattacctccacctaaagcagtgtaacaccagagcgttcagtcccagatcagatccttttaggacagaagtgtgtttcctcattttggagtggagctgtgagtggatgcatgctctgtcagcttgcatttgtccactctctgtgcaggctccgtgagagtctcagagctgggccgggccacatgcatcaggtccttctctcctctgggtgtcctcgggggcaccttgggcctgagtctccctccaagaggcagaaagtgagtctggtggactagagatctcacccattctgtgggctggggttccaggcagcccagctgtcacctgggaacatctggaggagggttggccctcagcactcagcgggtgcccgtggtgtggaggatccacagtcagcccatgtgaatgagctacaggaagtggtaatcacgtgtagaaaaaataaaagcctgggaggctgcaaacagaacagaattcttgtttcatgaggcacaggagcattgctaccaccagtctcagagcactgtgaagggacacacagatcccagaatagtcaggaaaaggtttcactataaccaagaagtcatgttagtgatgtgttagtcacagacagcacccacaaacctgggcacttggcagacgcgtaccagctttgcgtacgtcctgggcagagagctggttccacaccatttgcatggtctgcaggagcttctgctactgaatccatgttgggtggttgatggggagcagcccctgggatgggcctgctgggattgttcatcctatcagtgtatttggtgtcctcctcttctctgtt

SEQ ID NO: 44 - DNA, 694 bp, Equus caballus
  Oligonucleotide Sequence
tgcatgcgcagagcccctctcaatgggaggagaggtgagtaggaggaggaaggttagcagtgccctgagtgatgtccagttccattagacactctgtccccatcttcccaacagtctatgtggaaggaaaggaaagaatttactctgttaggaatcttctcgaagaaaatttgaaacctgtgagtcacagtcaaagaaacttatccacgaaacataattcatgttttcatgagtcctatagatgtttgagtcagaagaagaaggagggaggtgactgtgagaaatcgcccctttttattcaacatctggggattgcaaatgcagaaggaaatctatttggttaggcctaggccatgccttggctgagtataaaatagcttagtcgtgaaggctcagatagtctgtacgtgaactgctccaagcggggttactggcacatgtacagaggcattcagcgtggactgtgcctgagaccgacagggcggaggattcgatcccagtgagagctgagtcatttgttacaggtatgaacgcccaaggaaattaccttttagcaaaagaaagttaaatgatttaacagtccccatatgtgttaatgtctcacatgtatttgtatcataacgtgtaacataattgtggaacaaaaatatctacaataaatcttttagtatttgtgaaaaaaaaaaaaaaaaaa

SEQ ID NO: 45 - DNA, 6504 bp, Homo sapiens
atggcggcagagacctcgcaaggctgcgaccaggctctctggagcagcagagggcatgccaagctctacatcgtcgctgccgctgccctctcccatcgcggggttcccgcgcggtccccgcccgagctgggcccggtggagcagatgactaggcccggcgtctgccgcgcggggcgcatcctttgtctgctccgcggcgcccggtgcccgaggcccgcgccccactctttgggcagacaaagccggggccgccgcgagcccggcgggctagagctgggctcgcaccacccttctcccgcctcacggaccgccccctctcctggacgtcctctgattggcctacggggctacaaagaggccgggaagcgggcggatcacgtgggcgactgtggcttcccattgggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagagaccagaatgggcgcaaacttttgggttgggttcgcgcacccagcctctctgcctgggttatttggggaagtttgaaagcccgcatagtacctccttcaaccactgggtcaaaagctgaggagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccatttatagagaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagctccaatatgcctgggaaaattggcctttaaagcaatgctcactgacctgctagttcgttttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacatcacaccacttatcatgaacattccctggttcctatattttgggctatgtgggtaggaattgttacttgttactgcagcagcagccctagaaagtaagcccagggcttcagatctaagttagtccaaaagctaaatggtttaaagttaagttttaatactaggcacaagcactctgtaatacgttaaatttcagcccaagcaattaggaaatgtttctgaaacattagacttatatttacgtcactaaaattctaacacaaattttaaaaccgtgtctcatacatatgctgtactaggcttcctgatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 46 - DNA, 2127 bp, Homo sapiens
  exon (1)..(2127)
atggcggcagagacctcgcaaggctgcgaccaggctctctggagcagcagagggcatgccaagctctacatcgtcgctgccgctgccctctcccatcgcggggttcccgcgcggtccccgcccgagctgggcccggtggagcagatgactaggcccggcgtctgccgcgcggggcgcatcctttgtctgctccgcggcgcccggtgcccgaggcccgcgccccactctttgggcagacaaagccggggccgccgcgagcccggcgggctagagctgggctcgcaccacccttctcccgcctcacggaccgccccctctcctggacgtcctctgattggcctacggggctacaaagaggccgggaagcgggcggatcacgtgggcgactgtggcttcccattgggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagagaccagaatgggcgcaaacttttgggttgggttcgcgcacccagcctctctgcctgggttatttggggaagtttgaaagcccgcatagtacctccttcaaccactgggtcaaaagctgaggagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaa

SEQ ID NO: 47 - DNA, 1708 bp, Homo sapiens
gcagtagcagaatcccatggtagccaggtgggtgaaggggagcgaggacgtcccacctgccttgaagaagacgccttctgacctgctgagtgagtgaccaggtggtcccaagagcctgacgatggacgccatgcacatcaacatgtccagtgctcctctggtgaagcacactgctggagctggactcaagaccaacaggccccgagtcatgtccaagagtggacacagcaacgtgagaatcgacaaggtggatggcatctacttactctaccttcaagacttgtggacgaccgtgatcgacatgaagtggaggtacaagctcaccctctttgcagccacctttgtgatgacctggttcctgttcggagtaatctattacgccattgcatttattcacggggacttagagcccagtgagcgtatttcaaatcacaccccctgcatcatgaaagtggactctctcacaggggcatttctcttttccctggaatcccagacaaccattggctatggagttcgctccatcacggaggaatgtcctcatgccattttcctgttggtcgctcagttggtcatcacgaccttgattgagatcttcatcacgggcaccttcctggcaaaaatcgccagacccaaaaagcgggcagagaccatcaagttcagccactgtgctgtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgccaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagttcgaacagatccggaagagcccggactgcaccttttattgcgcagatgctgagaagcagaaacttgaggagaagtacaggcaggaggaccagagggaaagagaactgaggacccttttgttacagcagagcaacgtctgacggcagtggtgtcactgctgtttaactctgcgagctgtttccacatctgagctcgctccaaaagcaaaggtcgctgtgaaagcaaaactgtgtggatgcactctcaaaaaacctcacaggctacaaacttgatcttttcctttgatctggtggctaaacaagcatttccatgtttgagaggcttccttttaaatgctttgtctgaagcaaactctcaaaattcagattttctaaagtggggctacatttcgaagaacttggtgtagagcaattgaaaaaatgtcctgctggatggacagacattgatgctgacattgaaaggaacggcatttctatacaagattattagctgtaatacaagatatttatttaaccaatgaccttatggctgagagttgaattgtggttcagtattcattgatctcactgctttaaaacatgctccttttgttcaagcag

SEQ ID NO: 48 - DNA, 1128 bp, Homo sapiens
  exon (1)..(1128)
atggacgccatgcacatcaacatgtccagtgctcctctggtgaagcacactgctggagctggactcaagaccaacaggccccgagtcatgtccaagagtggacacagcaacgtgagaatcgacaaggtggatggcatctacttactctaccttcaagacttgtggacgaccgtgatcgacatgaagtggaggtacaagctcaccctctttgcagccacctttgtgatgacctggttcctgttcggagtaatctattacgccattgcatttattcacggggacttagagcccagtgagcgtatttcaaatcacaccccctgcatcatgaaagtggactctctcacaggggcatttctcttttccctggaatcccagacaaccattggctatggagttcgctccatcacggaggaatgtcctcatgccattttcctgttggtcgctcagttggtcatcacgaccttgattgagatcttcatcacgggcaccttcctggcaaaaatcgccagacccaaaaagcgggcagagaccatcaagttcagccactgtgctgtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgccaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagttcgaacagatccggaagagcccggactgcaccttttattgcgcagatgctgagaagcagaaacttgaggagaagtacaggcaggaggaccagagggaaagagaactgaggacccttttgttacagcagagcaacgtctga

SEQ ID NO: 49 - DNA, 1375 bp, Equus caballus
  Oligonucleotide Sequence
gaaaacagtggctgcaaagcaccccaaaaagcctttcaagtgccttctgttaatattgatttatacggtttaaatgtgcctgattcttccaggaaaatctcaattattgcactcagctccatttctacctgttccattacccaagataataaattagttactgcgttgtaaagacagtggtctcttctttgttcgttaaaataaggttgtgtttctctgtttacattaatgaagtctgaatttaaaatggtgataaaaccaagatttagtactttctaaactcaaggaaattatttctagacatgaggtaattcttttaaatttaaactgttgtacagatcccttaaatgttcttgttaagtacctactattctgctgaactttaaaagttaattcccacatttacaggaatctatgatatttaaacattttttattgctcattaatgtttctgagtataatatatatgccttatttttagacttgtaaaatgtatgaaatctcactagtgcacggacatctgtgaagttagcagtgagttggaattttaaatgactatgtgaaggatacgcaaaatatgttaactcttgttacttttgtatgtgattgtataagcatgtgactgtattataacattgttcactttgaaaactaatatagatatgcttgattctgaacaataagtgtgacttgtattgaacagtttatagactgtgttccttatttaacacaattatgaattcttccactcgttcataatttgtacatctcactgcttagcttagattcaagtctgtgtttatgcatttatgtacctgctgatcatcactgtgtactcagaattactgtaggagtattctgactctaacatggacttttaaaaatctttcaataacctgccagtgggatatgctcactgatctgtgcttaagttgaagatataacttgtcttgaaggatatttaaatatttagagatcatgcttgcgttactaggacgttgtctgtgatggtgtccacgtgtggaggagccgtgtgctggtgacagccagctttgtctgtcctgccttctcttcaggtgcagccttactggtcctcaccttcatgaccgtcctgactgtatattttcaagtcagccttgctggatttggagtcttactgactttgtgtttttgtagttgaagttatggaaatgctttttgatttgtatttagatattgaagtcattcatcagatagcacatttgtatgtctgagcctcatgtacctatttgaagtcatatttttaaaaatatatttacaggtttatttgtgactttttatcatttcttcaaatatttcatgtttacattaaaaaaattcccagagaaccaaaaaa

SEQ ID NO: 50 - DNA, 3356 bp, Homo sapiens
  Oligonucleotide Sequence
ggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataacagagatagaaagcacagaaggagcgtggatcggaagcgaagggatacttcaggactagaaagaagtcacaaatcttcaaaaggtggtagtagtagagatacgaaaggatcaaaggataagaattcccggtccgacaggaaaaggtctatatccgagagtagtcgatcaggcaaaagatcgtcgagaagtgaaagagaccgaaaatcagacaggaaagacaaaaggcgttaatggaagaagccaggctttcttagcctattctttgcagcagaagatttcttgatgagtaaaaggattacctttccttgtaaggaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaataataataataaaaaaagattaacatcccttgtcatcttttttaaatatcctatactctgcagtaagaatgtatattttaataggtaaatctttaagtctgttcccttctaattctgtatcatacattgcttttgtagaaataaatgtgcatttctttcattagttttgagatgtcctcgttgacgcttgtataataaatatcctcttgataccattttcagcttttatcactagatactgaacgtgattagaatgtctttgaaagtttcctcacttttatttgccttaggcagttattttgagttgtcaaaatcagatctttgcagctttgagggggaacataatagttctccgtgaaatcatttactgttttttctaatctcccttgttattttaatctaagcattttcccctcctcatctttaaaccacgtatttggtagataacttaaaatagtataatttggttggcattttcttcatgattatgggagcatcattcttttgtctccatggttacttgtgtgatacagcatatatatctgttaaagaaaataatcacttctttctaggggagggaggtagaaaagtatattctaaatttggtttttgagtttgtggtcttgtcttaacttttgtgttggctctaactctgaaacatgccaataatgtgttttcaagaatttttgtttaagtattgtatgaaagtttacaaaatgaaggaagttaatctacacttgaatctgtgagcaagataacacgcaagtgtaccaagtgattattaactttgttttataaatttgtatgaatttggagtatctgttgcccattactatacatgtgcaaataaatgtggcttagacttgtgtgactgcttaaaaaaaaaaaaaaaa

SEQ ID NO: 51 - DNA, 2154 bp, Homo sapiens
  Oligonucleotide Sequence
  exon (1)..(2154)
atggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataacagagatagaaagcacagaaggagcgtggatcggaagcgaagggatacttcaggactagaaagaagtcacaaatcttcaaaaggtggtagtagtagagatacgaaaggatcaaaggataagaattcccggtccgacaggaaaaggtctatatccgagagtagtcgatcaggcaaaagatcgtcgagaagtgaaagagaccgaaaatcagacaggaaagacaaaaggcgttaa

SEQ ID NO: 52 - DNA, 4300 bp, Homo sapiens
gaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatgggggcttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagagggtaaaggacttgcacaggatcaccaagtcatgctgtagagccaggattcctagacccagggctctgcactctcaaggctggccccatgtgctcaagggcctccaatgtttgcgctccagaccagccgtctgcaagctggacttctcatttgctgccaaacccttggcttacatatgcagtagaaagagccctggagttagaagccctgggttttcaagttgatgttcctctacttactagctgtgccactctgggcaaatgctcttccttgagcctgtttccacacctgtaaagtggggatgatgatcctatctcactgcttttgtgaggattacaggaaagcacctgtcctggttctgcacctggctcatggcaggtgctcagtacatggtggtgtccttccttcgttcactaaggacctgctctgagctcacacctcggctgcatgcaccctgctgtgacggaggctagtgtggaagaggtcctgtcctcagggaattaactgtcttattgggagacaacaactaccctgcctggggcacccaggaaaccatccgaggcagtggacaacacagaacacgccctcctcctcgctgcctgcagctccaatctgattctgcttgggaatgggctgagcacgtgggctgcttaactgctgtataggacaagccccttacccctctctgggcccatgaattcctggctctctttatgttctgatttgacacattcattgcaatctttgaatcatgaacatgagtgcagaggaaggtggcattccatcagcagaagagagatgttggtgtgggaccctgagactacactgggtagatgctagcttttaattatgattaatataagggatcaaattaatttaaatatgattctgaagtctacagaacttttagttctgtgctgtctatgtggacactttggtaaaatgcaaattatgatatggacgttatcattggtctggtgagctgtttaatatttgtgacagataatttaaaaattatgacttaatgctgcctgtgtctatggggttctgtcttctttgatagccatctattcatctggatcatgggaccctctctaatccttccaacaatcaaataagctatcgatattgttttggagttgagatatcagtctcggaaacttctgaaaaatgctaataattacccaaggattatgtcaaattttaaaataaatgtgtgtgtgtttctttaaaaaaaaaaaaaaaa

SEQ ID NO: 53 - DNA, 1221 bp, Homo sapiens
  exon (1)..(1221)
atgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaa

SEQ ID NO: 54 - DNA, 1176 bp, Homo sapiens
atggcagacattgacaacaaagaacagtctgaacttgatcaagatttggatgatgttgaagaagtagaagaagaagaaactggtgaagaaacaaaaatcaaagcgcgtcagctgactgttcagatgatgcaaaatcctcagattcttgcagcccttcaagaaagacttgatggtctggtagaaacaccaacaggatacattgaaagcttgcctagagtagttaaaagacgagtgaatgctctcaaaaacctacaagttaaatgtgcacagatagaagccaaattctatgaggaagttcatgatcttgaaagaaagtatgctgttctctatcagcctctatttgataagcggtttgagattattaatgcaatttatgaacctacggaagaagaatgtgagtggaaaccagatgaggaagatgaaatttcggaggaattgaaagaaaaggccaagattgaagatgagaaaaaggatgaagaaaaagaagaccccaagggaattcctgaattttggttgactgtttttaagaatgttgacttgctcagtgatatggttcaggaacatgatgaacctattctgaagcacttgaaagatattaaagtgaagttctcagatgctggccaacctatgagctttgtcttagaatttcactttgaacccaatgaatatttcacaaatgaagtgctgacaaagacatataggatgaggtcagagccagatgattctgatcccttttcttttgatggaccagaaattatgggttgtacagggtgccagatagactggaaaaaaggaaagaatgtcactttgaaaaccattaagaagaagcagaaacacaagggacgtgggacagttcgtactgtgaccaaaacagtttccaatgactctttctttaatttttttgcccctcctgaagttcctgagagcggagatctggatgatgatgctgaagctatccttgctgcagactttgaaattggtcactttttacgtgagcgtataatcccaagatcagtgttatactttactggagaagctattgaagatgatgacgacgattatgatgaagaaggtgaagaagcggatgaggaaggggaagaagaaggagatgaggaaaatgatccagactatgactcaaagaaggatcaaaatccagcagagtgcaagcagcagtag

SEQ ID NO: 55 - DNA, 1176 bp, Homo sapiens; identical to SEQ ID NO: 54
  exon (1)..(1176)

SEQ ID NO: 56 - DNA, 2418 bp, Homo sapiens
tatattggcagttattgagggtaaagcaatatattgtaacagaatgtataaatatttttgataaaacagtctatattttattaaaaaatgaattataacccattttcagttttgcctgcatcataagagtgagcactccattgctttctttcctggccacactgctacaatccagcactaactatccatgtccaggttgaggatcgagatcgggcagcccacggtgccagtgaaaaagctaagtctttgctgcataaattagaggaagcaatttcggaacaacggactctgcaggctataaatactgagttagtgaacacttgccagacacttgagcagaagacaagaaaactgaagaagctttttagatgaggaatttcctcactatgattccctgtcctgcgcagatgcaattcaacaacctcttcaagaaaaattgaagcagtgttgccataaactatatagtggtcaagacgccagaatacatcagacgcccctgaccttcaaacatacatgctggtacacacctctgctggatgccttgcatctggatagtcttacaacgattccaaggctggaattgacacctttctcatgtttggccaaccgaatccatgcttcatgtgaaagacctaaatatggagaaatagaggatggtgctttggatgtaaaaagacaacacaagtgcccaggccccacaagtggccccagcccaggaacgaatctttcaggttgcatcaggatgagtgatgacctaagtatgaacgagaatggtgttgaacgcgtgtgtcctgagagcctgctgcagtccaggggatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgactgggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagaaccacctgaagaagaaatagtagaaagaacaagaaagccaagtctttctgaaaagagaaataatccatcgaaatgggatgtctcttcagcttatgacacaatagcttcctggacaacaaatctcaagacttccatcggaaaggctaacaaggcactctgtttgtctgttgccttcattgtactgtttgcagctttgatgagcttcctcacaggcctgtttttccaaaagtccgtggatgccgctcccacacaggatggggactcctggatgtctctagaacatatcttgtggccatttaccagacttagacacaatgggccaccaccagtgtgactgcagcacatcccaatgtgtgcatcttgatttttaaggtttcagtatctgaactttgtaaattagtaaattttagctggaaaattatagcatggaaccaaaggttctcaggatgcctgtaagatattttacattccctctttttgtgattatctccccaactgaaatacagtggg

SEQ ID NO: 57 - DNA, 1668 bp, Homo sapiens
  exon (1)..(1668)
ctggaattgacacctttctcatgtttggccaaccgaatccatgcttcatgtgaaagacctaaatatggagaaatagaggatggtgctttggatgtaaaaagacaacacaagtgcccaggccccacaagtggccccagcccaggaacgaatctttcaggttgcatcaggatgagtgatgacctaagtatgaacgagaatggtgttgaacgcgtgtgtcctgagagcctgctgcagtccaggggatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgactgggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagaaccacctgaagaagaaatagtagaaagaacaagaaagccaagtctttctgaaaagagaaataatccatcgaaatgggatgtctcttcagcttatgacacaatagcttcctggacaacaaatctcaagacttccatcggaaaggctaacaaggcactctgtttgtctgttgccttcattgtactgtttgcagctttgatgagcttcctcacaggcctgtttttccaaaagtccgtggatgccgctcccacacaggatggggactcctggatgtctctagaacatatcttgtggccatttaccagacttagacacaatgggccaccaccagtgtga

SEQ ID NO: 58 - DNA, 1118 bp, Equus caballus
  misc_feature (1030)..(1030): n is a, c, g, or t
aaagctgagaagacaatgatcctaaacagagctctgattctgggggccctcaccctgaccaccatgatgagtgcctgcggaggtgaagacattgtggctgatcactttgcctcctacggcacaaacgtctaccagtcttatggtgattttggtcagtacacccacgaatttgatggagatgagaagttccatgtggacctggagaagaaggagactgtgtggcggctgcctgtgtttagcgagtttacaagttttgacccacagggcgcgctgcaaaacattgctacggcaaaatacaacttggacatcttgattaaacgttccaactctactgctgctaccaatgaggttcctgaggtgactgtgtttcccaagtctcctgtggtgctgggtcagcccaacaccctcatctgtcttgtggacaacatcttccctcctgtgatcaatgtcacatggttgaggaatgggcactcagtcagtgaaggtgtttttgagatgattttcctccccaagactgatgattccttcctgaagatcagttacctcaccttcctcccttctgctgatgatatttatgattgcaaggtggagcactgggggctggatgagccacttctgaaacactgggaacctgagattccaaccccaatgtcagagctgacagagactgtggtctgtgccctggggttggctgttggctttgtgggcatcgtggtgggcaccttcctcatcatccgagccctacgctcaggtggtgccttaagacgccaaggatgcttgtgagttgcatcatagaagggaaggcacattgcccatctacaagagcagaagagtggatgtgctagatgacctcgcactatttactggcccagttcatcatactccttctcttcttcatcgtttttcctctaaccttttccctaggacttaaggtgctgtatctcctaagagctctcatactcttcagaattctccccctgactgccggattattttttctcttctcacttgttacctactatgggatccntgggacattccacctagttacctaatctctagggacctgatccatgtctccatggaagcaataattctcctttatgagatcttttatt

SEQ ID NO: 59 - DNA, 768 bp, Equus caballus
  exon (1)..(768)
atgatcctaaacagagctctgattctgggggccctcaccctgaccaccatgatgagtgcctgcggaggtgaagacattgtggctgatcactttgcctcctacggcacaaacgtctaccagtcttatggtgattttggtcagtacacccacgaatttgatggagatgagaagttccatgtggacctggagaagaaggagactgtgtggcggctgcctgtgtttagcgagtttacaagttttgacccacagggcgcgctgcaaaacattgctacggcaaaatacaacttggacatcttgattaaacgttccaactctactgctgctaccaatgaggttcctgaggtgactgtgtttcccaagtctcctgtggtgctgggtcagcccaacaccctcatctgtcttgtggacaacatcttccctcctgtgatcaatgtcacatggttgaggaatgggcactcagtcagtgaaggtgtttttgagatgattttcctccccaagactgatgattccttcctgaagatcagttacctcaccttcctcccttctgctgatgatatttatgattgcaaggtggagcactgggggctggatgagccacttctgaaacactgggaacctgagattccaaccccaatgtcagagctgacagagactgtggtctgtgccctggggttggctgttggctttgtgggcatcgtggtgggcaccttcctcatcatccgagccctacgctcaggtggtgccttaagacgccaaggatgcttgtga

SEQ ID NO: 60 - DNA, 2297 bp, Homo sapiens
aaaaaccccagcaggttagcttctcattaaatagcttctcctgagggcagaccttgttaagaagaacaaaatgctctggcgtatttcaaaatggctccttttccccacccactaccagaggcatggataatcaccctgaggacctgtgagagatccaggagcttaaaaaaaattggggagcggggaagagggaatggctaggtccctctgacttgtccacactgatccttcaggtttacctatcctggtacttgttccattggaggcttcagcggctagtttctgctctgtggttaccaatgacacaggagctgagcttccaaaaatttattgaacaatctgacttactaggagaacttaaatatgacttcaatgaaaaagatgaattcagacatactgagacacaaaggccttttgtctttaactattatgaaaatgtccttgagaaaaatagcaagcgctaccaggcccttggccatttgcttgaacaatacatttatgagcttttggagaaagtgtgcaaattagaaaaagtatatatcccacctgaggctgataaagaagaaccaagaagcttctttttcatgagcgagaaagcattaacaaatcaccattctgctcttcttatccttcttcaagaccatggggtctttcgagctggtcagtggagtcaacaggcaataatacatcatggtctccaacatggaagtcagataccatgtattcaaatggcattgcaggcacactatgatgtaattgtgctaaaccccaatgataattttgtggaaccaaaggtggaaaaagagtggaaaggccttttaacacaaaatattgagtcatcttctctaaaaatggttcaaggtgggagctttttctctctccagcatcctcccaaatgcattccaaaaagatgcagcaacacccccgaagaacacacggcttacatatgggattacttcatttcaaagactgaaggcaaggatattgccttcattgtacatggttatggaggcttggtttttatggacttgcttgttcgtagaaggtgggaagtgatgagcaaagtatatgctgttgcacttatcgactctgaacatcacgtaggacaccagctgggaagtgatgtacaattattagcatggataaagcaccactgccgtgaatgggtgacaagtcctaagcctttggataaacctgcagctactgttttcaaaaaggaatttcctatggtttctgctggcacagaaaagtacatcttagccccttcctctagccttcagtcaatttttaagtactttaaaaaagctttaaaagccagaacaaccattaatttctctcgaatgccaatagtgactagaagctccacaaaaagaaagcaaagtgcttaaactacttttgtcatctaagatttttttgtccttctgcaactttgctaatacagattctggaagaaaaaaaaacactttcaactcacacacaatatgatgttctggcttgaggtttgatttgttactttttattatttggtttttatgaggcagggtctgactttgctgcccagggtggtatggaaatctggcctcaagcgaacctcccacctcagcctcccaaagtgctgagattataggcattagccactgcacatggccatggccaggtttgttgctttttttttttttggaggaggaggaggaggagtctctgtcacccaggttggagtgcagtggcaccatctcagctcactgcaacctccacctcctggtttcaagcagttctcctgcctcagcctcccaagtagctgggactacaggcacatgccaccacgcccagctaatttttgtatttttactagagacgggctgttcgccaggctggtctaggactcttgacctcaggtgatccacccaccttggcctcccaaagtgctgggcttacaggcataagccactgcacctggccattttgttgtttttttgaaaagtgaacatattctctcttttgtagcctgttgatgaactgggaattcagtgtcatcgttaatattttacagtgttagttaagtgtgaagatctttcttttaaaaagctgtggtttgatataatgacaacaaaatggcaattgataaaaattagatattgaatcaatctttgatttctataataataccatagtaaaattacaagtgaacataaaaattaaacatcataagcaaactgcattctttgtgtgtttatgttttttgttaagatttgttgtactccctgttcaccaggtctgaagaaaaataaattttaaat

SEQ ID NO: 61 - DNA, 6121 bp, Homo sapiens
acaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttcaactatgtctcctgtcacgcttcaacaaaggcagggccaaaagttgtctctcatttgcttcgtttggtggataagaaagagtccttggagaatatacttgaatctgatgactacctgaaacaccgtccagaaatttcagtgcacatggaatattttagggtgttgtggcaattatctccaaaatattacttttcccaggtttcagaacatttacttgctcttgccataaaaatcgcttatcaaagcaatgctcttgctgcatgttctccatttattttgagattccttcaagggagaaccctgactttcaatatgcttaagtcacagtacttttttgaccaccccgaaagcctattgttgttgagaagcatccagttctcgataaaaggaaggaagtcaagcagactagatctttcagtcctggaaacgtgtttggacaaatcacaggcaccgactatcgatcaggactatgcttctgcctttgaaccggcgaaagaatgggagcagaatttagcagaaaaagaggaaaacgtgaagagttttctggatatgcaactcaatgcaccaccagacatcagcactggctattggaaactttctccaaagccatacaagattccccttctggaagtccacgtgactgatatcgacgctgtggaccaggagatgctcagggttctaacggcagttttctcagcttcacagcacatcgaactccacctaaacgactgcaggggctttccggaaagcgtccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 62 - DNA, 4209 bp, Homo sapiens
  exon (1)..(4209)
atggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttcaactatgtctcctgtcacgcttcaacaaaggcagggccaaaagttgtctctcatttgcttcgtttggtggataagaaagagtccttggagaatatacttgaatctgatgactacctgaaacaccgtccagaaatttcagtgcacatggaatattttagggtgttgtggcaattatctccaaaatattacttttcccaggtttcagaacatttacttgctcttgccataaaaatcgcttatcaaagcaatgctcttgctgcatgttctccatttattttgagattccttcaagggagaaccctgactttcaatatgcttaagtcacagtacttttttgaccaccccgaaagcctattgttgttgagaagcatccagttctcgataaaaggaaggaagtcaagcagactagatctttcagtcctggaaacgtgtttggacaaatcacaggcaccgactatcgatcaggactatgcttctgcctttgaaccggcgaaagaatgggagcagaatttagcagaaaaagaggaaaacgtgaagagttttctggatatgcaactcaatgcaccaccagacatcagcactggctattggaaactttctccaaagccatacaagattccccttctggaagtccacgtgactgatatcgacgctgtggaccaggagatgctcagggttctaacggcagttttctcagcttcacagcacatcgaactccacctaaacgactgcaggggctttccggaaagcgtccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataa

SEQ ID NO: 63 - DNA, 1507 bp, Equus caballus
  Oligonucleotide Sequence
ttaaagaatgaaagaaagccgtttcacaaagaagtagtggtgcttggagtcacattgggatagattttctggtgattcccagtctgtaaacatcacagatgttagtttaatggaataggatacatactgcattggctcctgttgaaatttgaggaggagaattggcttgaagcttaggtttccttaccgaaagcggctactcactttcttaagtgagggtcctttcattcaagacaaaaattttcctgccccttctgtttgtagtctccaaaattggaaggagagctttatcaactgcaaagtacaaattaagtgcccttgccaagctgacttctcttaattacactattgttcacactgattgccgtcctttagttctttcctgctaaacaatggactagtttcctcctcagtcacttagagctgattaatatcagccttggtaaaccaaaaatgtgaggctacacctaatccagattgtctgcaggacttttctcctgcatccctgcttgaggaagctttctctagatagcaggtggccatcgttactttattggttcagataacgttttataccgtcttaggggcgctgatctgctattctggaaaggttttatcttaataaaggtgaactaacagtgcagccaactacttctacctggatacttttcttccatcctacctctggatctcatacttcttcatcactcaagacctggatgccacctctgtgaaacgctccccaactcaccgttagtaggagaagggccgttattttggtttccgtggtcctttccagagagctgtgctgttcatactaactgttgtaatggaatgatttgatagcatgtctccattttctttcaaactgaaaatctgtgtatctccttgcgtatgctcagcacctaatgcacatagaactttacaggtgcttggtaaattaaccacacttctgttgtcttttcaaagactttcaaaagtaataccagtttacaaagagttaattctctagggttctagaagcacaaatcaggaacggtactatttatttttggttctctgctgtaaaaaatatcaggttacctgcctccagagttctaaaaagagttgtgtattttcaaacagcttttcaggatgtaaatactcacaaagcaacatatgtatataggaatagatttaaaatggaatttaaaatcacctttactgacggttgttggttgtttttttgttttgttttgtttttttttactgtttctctgagtaactttgtatctaaatgtttgttttgattgtggaagaaaagacgtggtgggtacaaattacagatgtatgcgtgagaaggccccgtgatataatagtgcttagcattctctgttgtaattgcgtgtctgtcctttcctcttgtccttaaactccatagggcaggggtcagctctgtattattgaccattttattccttatgtataacataatacatgataaataataggccttcaataaatattt

SEQ ID NO: 64 - DNA, 2600 bp, Homo sapiens
gagaggccgtgtagcgtcgccgttactccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagatacggatgggccagatggctatgggaggtgctatgggcataaacaacagaggcgccatgccccctgctcctgtgccagctggtaccccagctcctccaggacctgctactatgatgccagatggaaccttgggattgaccccaccaacaactgaacgctttggtcaagctgctacaatggaaggaattggggcaattggtggaacccctcctgcgttcaaccgtgcagctcctggagctgaatttgctccgaacaaacgtcgccgatactaataaaattgcagtgtctagtttcccaaaacccctaaaagaaggaccctttttggactagccagaattctaccctggaaaagtgttagggattcctcccaatagttaggtcttccctgcctgtacaacttactctagggagtatgctggaggcagagggcaagggaggggcgatatgtaacaaatcagttctgtgtggtatttcgtttaatcaattctgtgtggtgcattcctgaagtctcatgtgattgttgagggcctgggggggaaccatggcaaaatggatccagttagagcccccattaatcttaatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagacactgccacatataccacaaaaaaccaaatgtcccccaatgaccttagccccattgctccattcactcccaggtgggaattcaggcaaatgtccgcagaggtcacagacaacgtgcatacggttctgttatatcccatatattaccccttcatgtcctaaggaagacgttttctcttagtgattttcattttagtatatcttttaaaaaatcttgtgttaacttgcctccatctttttcttgggtgaagacaacccaggaatggcccttttgtgtctatgatgttgctgttcacagcttttcttggtaggcttagtacaatcttgggaacagggttgctgtgtgctgaaggtgggacagtaactcttagccttgcctatcttaggtagttacgctgtgcattttttattggtgtaccatgtttgatttgtccctgatacctttggagtttttctgaaaaatggagcagtaatgcagcatcaacttattaaaatacagttttaagccttttaaaaaaaaaaaaaaaaaaaaaaaaaaaa

SEQ ID NO: 65 - DNA, 1416 bp, Homo sapiens
  exon (1)..(1416)
atgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagatacggatgggccagatggctatgggaggtgctatgggcataaacaacagaggcgccatgccccctgctcctgtgccagctggtaccccagctcctccaggacctgctactatgatgccagatggaaccttgggattgaccccaccaacaactgaacgctttggtcaagctgctacaatggaaggaattggggcaattggtggaacccctcctgcgttcaaccgtgcagctcctggagctgaatttgctccgaacaaacgtcgccgatactaa

SEQ ID NO: 66 - DNA, 951 bp, Equus caballus
  Oligonucleotide Sequence
ttaaattctgactctgtaaatgcataagagatgttaaaaataacaatgcactttgaggaatgtttgcatatgcctctgattaggaagaaaacatttgtctatgctctgcagtggccaatgaagaattactaatgccttattttctaggcatagattagagaatgtagaccagacaatttgtttactattacaagaagactaccagtttgcttacaggagattattttttgtgaacagtaggtttgagtccaagaccatttgaagaattacaaactctttcttaaaaaaaggaagaagtctgcttgaaatgaatgcaaaatttccttttagtccatcacattcaaatgtcttggttgtgacctgttaccagtataggagagaagcccaaatcactgtttagatcaaaacattcttcatgtaggtaactataagaggctagtgcctacaaattacttcttcatgcattgttgggagtctctgaaagcactggcaattttaagagtctttctcagggtaacttaatgttttcttaatgaacaatgttttcagctaaaaagtccttccaagtatattatctgccctttcaaaaagtaatcttataaaagaactttagcactttctcaattgatttaggctattttcagtattcagaaatgattttgatctctgtagaattaattgtctgcttgaaaattatttttcaaatcccttttagtggcaacatttttttctattgaaggtcaaaggattggaaactggttcttgtatccatgtaacgtgttatgtgaaaaagtattcatgttggcaattttagttaagcattatggtgtgggtgtaatttttaaaacttaattcagtgtctcgtctgattaaagcaggcactgatcagtgtatctcctaagaggtagtttacctcctattcccttcctataatccttacattctaaattt

SEQ ID NO: 67 - DNA, 676 bp, Equus caballus
  Oligonucleotide Sequence
gcttttgcaaaaacggtctcgaccctggtctggctccttttgtacctcacctctctgccaaacgtgatcttaagcaacaaggaagccacaccgtcgtctgtgagaaagtgcgcctccttaaagggtcctctggggctcaaatggcaccaagtggtgaataacatatcccagttcattttctggaccgtttttgtcctaatgcttctgttttatgtggtgatcgcaaaacaagtatataattcttacagaaagtccaaaagcaaggagagcggaaacaacaaaaagctgggaggtaaagtgttcgttgtggtggccgtcttctttgtgtgctttgctccatttcattttgccagagtgccatatacacagagccagaccaacagcaggactgattgccgggtgcaaaaccacctgtttattgctaaggaaacaactctctttttggcagcaactaacatttgtatggaccccttcatatatatattcttatgtaaaaaattcacagaaaggctaccatgcatgagaggcagaaagatggcaacatcaacccaagaaaatcacaccatccagactgacaataacataaccctaggctgataactttattatggttagcttctatttatcaacaagactttaagagacaatttatttggaaataaaattaagcatgaaa

SEQ ID NO: 68 - DNA, 1302 bp, Equus caballus
  Oligonucleotide Sequence
  misc_feature (1190)..(1190): n is a, c, g, or t
tggagcctttgctgtctcaggtgtcctgatctcacttctctgtgtgtgtttggcaacagcaattttatgtcgctgtggttttgagaattttcttttttaaaaacatgaagcctttaaaaaaaaaatgatttgcgcctgtcctcactgtctggtgaagcagacagaaggagagcccgcctgaagcgtgtgcagggctcctgctctccgtgaccagcccagctgctcgcagcacccacgtcacctctcagggcttggggacccctggccacgagcattcactgttttcacggccaaataacaggacttctgtcaccactgtcagactgatttagtcttcataattttatgtgctagttttaatcggaattgttccctttttaaaattaattttttattattcattcttgatcatgttcatcagtagaggctgttcataagaactctgattctagcgaattagggtaattgatacctttctgcagttttgaataaaagcatttacaattctaaattattgttttataaaattcttacatttcagcattcccctcatcacatgctgatgtaatattgttttatattaaaatcgtcctttttgctgttgtgccaccattcacgcaagtaccgttagttcttaaaatgcgtttaaagaaaaagtgaccaagtcaactttcacacctccagtaatcaggtagattacaaacccatcctgggggacagtgcctgggcagatgtagtttctccccgctgcctgtactgaatagtgtgcagttagcgtggtcccctcacctcgtgcttggagtggaagtcgtcacgatcgcgagagttgacactcagatcaggggttcgccgctgctcgctgtggccgtgccagaggcagcctttccagagcaaatccagggccccacggcgctcatgccttctctgactgctttgcctttttcgttctgtaaattgactggaaagccatctttaataaactcctcctgtctctttatgtgtgcggtttatggccatggaagtgacacttgagggaagccagaagtttggttgagattgtgagaggctcttctgtgcttctatgatatcatacccgataacacgtgtgtaagttactaatatgtgaattgtgttaaatgtatcttccgtttgaattccctttggatgaaattatttcttgatgtgatacnatagtgccttgttctgatttttgttctttccctaaatgttatcaaatcagtagaaaagttagaaataaagtgaatatagcatttttaaaaaaaaaaaaaaaaaaaaaaaaaa

SEQ ID NO: 69 - DNA, 909 bp, Equus caballus
  Oligonucleotide Sequence
aagggacgaagcccctgtagccaaccctggccaccggtgtatttgagccatgagttaagagaacaaccttctatgcatgtagagactgccccaacccatgttcatccacaactgtccagagttccacagccatggatgtgcccacagactgcagggagaaggagtcatagcacatacagtgagtgaacagacatgatacagagaagagacatgttatgcacatttgacacgagtcctcttgcgtttcttggtctagatgaattgctaatggctatcacgatctgcgtccaggcagctgagctcaggggaaggcagctgacccctctcccacaggcccccagacccggtgtacccagaatcaggcagggcagaggcaggacacaaaggtaatgaaggacataggttcagggatttgttttcaggctgttgttgttgtttacattttgcatttttaaatttgctctctttttaatttgtttagagggaaagctatgtgtttttaattttttaattttcttgtttgttttggtttgtgatatctgtggagggagttttaagtagtgagctaatggaccttatctgttggcttagaggcctaataataatcagaccattttattccttgtttgggtgttatactttccaagtcctttcctctgaatcagtggtaatgaatatatttacataatcccttagatttgcttagtgcttttgtgattttcaaagcacttccatgagcattatcccttgcattcccttgacaagtatttatggaaagtctgctgtgtgccaaccatagtgttaggcatggggcatctaaaacaagtaagcctgggaccctgccctcacaaaacgaaaaaatctaaccaaagaggcaggtttgtaaacaaatgattataataaacacaa

SEQ ID NO: 70 - DNA, 681 bp, Equus caballus
  Oligonucleotide Sequence
  misc_feature (590)..(590): n is a, c, g, or t
gaggcatttaaaattcatgtatgatactcttataatcataactgctgctaatgcttgattatatactcagggacaatgtataacgtaagattacaaatttgttctcaccaactcccttttggatttcattaagaaagaaaaactcctggtcagagataatgtataaatcagagatgtaaatggctagttgtctatagcattaaatgaagggaaaactgataattaggcagttaatttggtcaattaaacaaccatgtctgcatctaggggagcctggcttatttgattgatttcctactagtctttgactctcccttcattctggtttccatgtgaatttgctttagaaaagccaagtatgggctgtttcacgtgttcagacttgtgttttcatagcattcatggcggggctgcaaggcttggaagtgaccaggaagacagtgagaacgcgtggttggacaactgaaatgatgcagatcagatggcgtttctcccagctcagtggattttctttggggttattcttaaaaatatccatcactacactggaagtccctgttctgactatgtactgtccacctgcattacanacattctgcagagctgctaagtatatacatatccgatgtgtgttacatcttgtatttaattaaatgctatgaaactgaaaaaaaaaaaaaa

SEQ ID NO: 71 - DNA, 2917 bp, Homo sapiens
ggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagaaatagattctgaagaggaacttataaataaaaagagaatcatagagaaagtcattcatcgactcacccactacgatcatgttctaattgagctcacacaagctggattgaaaggctcgacagaaggaagtgagagctatgaagaagatccctacctggtggttaaccctaactacctgcttgaagattgaggtattgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctg

SEQ ID NO: 72 - DNA, 2466 bp, Homo sapiens
  exon (1)..(2466)
atggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagaaatagattctgaagaggaacttataaataaaaagagaatcatagagaaagtcattcatcgactcacccactacgatcatgttctaattgagctcacacaagctggattgaaaggctcgacagaaggaagtgagagctatgaagaagatccctacctggtggttaaccctaactacctgcttgaagattga

SEQ ID NO: 73 - DNA, 3945 bp, Homo sapiens
agcggactttatcggaacgtgcctaagctgctgcagctggcacccggttgcgctcggcgaagagggctgggggcgggagatgacggtggtcttctccctgcttggcaccctgcgagcaccagctcccttctcctcgccactccaaggttgcagacgaagcaggtactgtcctagatgttaaggacacaacattgagcaaaaacatgcatagtccctgcttccgtgacacttgagtgaactgaatgtgcaaagtccctgtggcacaaagtccctggggccagtgtgtgtggcgggtgtagaaggagctaaagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtgggaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaggctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttacagttgtttatggtggctattcaaccaagagcctggaagactttatgttgagttacagtttttctgtgccgtgtttaactttggtcagggatttatttcatttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaatgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtacccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcagttgattgaatctatggatgtggaacctgtgcatatggagggtcaactgtactataaataatacgaatatgccaacattatataatcattgctttctgcaaaaaaaaaaaaaaa

SEQ ID NO: 74 - DNA, 2613 bp, Homo sapiens
  exon (1)..(2613)
atgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtacttaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctatagttgaagctttatatcaaactacatacccagaatatctccagtacatttatttggtggcaccaatatctcttatgatgttaaaccctatagggtttattttctgtgaaatccaaaagtgggaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaggctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttacagttgtttatggtggctattcaaccaagagcctggaagactttatgttgagttacagtttttctgtgccgtgtttaactttggtcagggatttatttcatttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaatgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaa

SEQ ID NO: 75 - DNA, 909 bp, Equus caballus
  Oligonucleotide Sequence
ttacagtgtgaagccagcttctgtttctgggtcagttaccagcagcagccacaaggtctgaaaggtgtgaggtggatcagtgatgctgtaccaccttctgaatgaatctgtccagcagagtaatgtctttttgtcttattctttgagaattttttttctttttccctttgattttggtattttcgtttgaagtctgaatgcttttcaaagttcaaggttctaaatcaatacttgaggatttgtagaataaagtaacggaactgtgtttggctccctagattttctgtttataaaaatagatctcaaagatcaataaagatgaatgccagcatttgcatagtactttacgtgtgaaagataagtcactgtgctgcatctttagttattttaaggcagaggattccttttttagtttaataatgaaagtttgagttaattggatatggaaaacaggaatcatttcagcaaaaatttttcctgtgggaacactatcattttaagaagattagtgatttaatgtgtattctcttactcttgagctttaaaaaaagtcaaaaacattttctgtatggggaggatattaatacccgtattttagttgtcatagagtaatttatacatactgtacaaagatatagttacactcccatatgaagatatagttaatgccatctttggccaagtgttaggagttttggctttgtagtcaggcaagcctatgttgggtcctggctgttgccacttaatagcggtgtgactttgcttaggtttctcaacttcgctgagcctcattatccacatctgtaaatataagaatgctacctttttaggttgtcctgaagatttaaatgaataaatgtgaagtatctaacctcaaataataatagcagttacttaacatagcttata

SEQ ID NO: 76 - DNA, 693 bp, Equus caballus
  Oligonucleotide Sequence
ttccttttttagtttaataatgaaagtttgagttaattggatatggaaaacaggaatcatttcagcgaaaatttttcctgtgggaacactatcattttaagaagattagtgatttaatgtgtattctcttactcttgagctttaaaaaaagtcaaaaacattttctgtatggggaggatattaatacccgtattttagttgtcatagagtaatttatacatactgtacaaagatatagttacactcccatatgaagatatagttaatgccatctttggccaagtgttaggagttttggctttgtagtcaggcaagcctatgttgggtcctggctgttgccacttaatagcggtgtgactttgcttaggtttctcaacttcgctgagcctcattatccacatctgtaaatataagaatgctacctttttaggttgtcctgaggatttaaatgaataaatgtgaagtatctaactcaaataataatagcagttacttaacatagcttatatgccagacaattttattaatttatttaatccttataacaatcctgtgaagttggtacagttattttcctcatttttacagatgaagaaactgaggctaatgaaaggttatataacttatgcaagctcgtacagctaataagtacataacactcgacaaatgctgactgttgtcataaaaaaaaaa

SEQ ID NO: 77 - DNA, 3775 bp, Homo sapiens
tgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcggagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgagaaagcagcattcctatattgagcaaggcaagaaatgccgatactgcgatgctgtttttcatgagcgttatgccctcatccagcatcagaagtcacacaagaacgagaagcgctttaagtgtgaccagtgtgattatgcttgcagacaggagaggcacatgataatgcacaagcgcactcacactggggagaagccttatgcctgcagccactgcgacaagaccttccgccagaaacagctcctcgacatgcacttcaaacgctatcatgaccccaactttgttcctgcggccttcgtctgttctaagtgtgggaaaacatttacacgccggaataccatggcaagacatgctgataattgtgctggtccagatggcgtagagggggaaaatggaggagaaacgaagaagagtaaacgtggaagaaaaagaaagatgcgatctaaaaaagaagattcctctgacagtgaaaatgctgagccagacctggatgacaatgaggatgaggaggagcctgccgtggaaattgaacctgagccagagcctcagcctgttaccccagccccaccacccgccaagaagcggagaggacgcccccctggcagaaccaaccagcccaaacagacccagcccatcattcaggttgaagaccagagtacaggtgcaattgagaacattatagttgaagtcaaaaaagagccagatgcagagcccgtggagggggaagaagaggaggcccagccagctgccacagacgcccccaatgggagacctcacatccaagatgatcctcaccatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtcagtgttgacaagaaattggatcacaatcatgtagcagaacggcacccagaccactgcccaccagtgacggacatgcacgtggcagatcgtgaattccagcccgcggagccagcatttgaaccttgtacaattaactttcagttatgatttcccatcgacattttctttgctctgtttgtagctgaattgtttgtgttctgtaaatcctctgttaaagcagaagggtgattatgagcgggtcacagcagcccttaaaagctgggccaggaaattcactaggtcagtaatttaaactttggatcttcaaaaaaaaataataatgtgaagcaaaaccaactaaaaagtgattcttgcacatgaactgtcacacgtttaaaatgtgttttttagagagcctcagtcttgctgatttcaaacacttttttcttctgtgtattgcttttaagagagccatcagttagctatcagactctaggttgatgcattttgtacttagctgtactgtgtgatatttttcattattttaggatgccaacaagagacctgtaataaaatatgtgatggggttgagagctggggaggaggatctactgctgtacagctaataaatcatacggattaacaagtga

SEQ ID NO: 78 - DNA, 2241 bp, Homo sapiens
  exon (1)..(2241)
atggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcggagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgagaaagcagcattcctatattgagcaaggcaagaaatgccgatactgcgatgctgtttttcatgagcgttatgccctcatccagcatcagaagtcacacaagaacgagaagcgctttaagtgtgaccagtgtgattatgcttgcagacaggagaggcacatgataatgcacaagcgcactcacactggggagaagccttatgcctgcagccactgcgacaagaccttccgccagaaacagctcctcgacatgcacttcaaacgctatcatgaccccaactttgttcctgcggccttcgtctgttctaagtgtgggaaaacatttacacgccggaataccatggcaagacatgctgataattgtgctggtccagatggcgtagagggggaaaatggaggagaaacgaagaagagtaaacgtggaagaaaaagaaagatgcgatctaaaaaagaagattcctctgacagtgaaaatgctgagccagacctggatgacaatgaggatgaggaggagcctgccgtggaaattgaacctgagccagagcctcagcctgttaccccagccccaccacccgccaagaagcggagaggacgcccccctggcagaaccaaccagcccaaacagacccagcccatcattcaggttgaagaccagagtacaggtgcaattgagaacattatagttgaagtcaaaaaagagccagatgcagagcccgtggagggggaagaagaggaggcccagccagctgccacagacgcccccaatgggagacctcacatccaagatgatcctcaccatgatggaccggtgatggcggagccttgtgcgtcgccaggacttctctgggctgtgtttaaacggcccgcatcttaa

SEQ ID NO: 79 - DNA, 802 bp, Equus caballus
  Oligonucleotide Sequence
atctgtattagccagagcattgggcttccaaaatacagccttctgttcattagatcttgaggattttaatagattgacaccccataccttatagaattggagttggaatatgatttctcaaaaatgaatttgataatttcaagtataatatgcatatgtgccaaaagaatgctgcaaatataattatgggtagccaaatttggggttatgtgaacattttatattgctcattttgtttatgtaattttttttctcggaaaaacagttgtttttcctctcagaagtgtttaggcattattgcacgtgagtttcagttctgctacatgaactgttagctgttttgtttgaagcaacacagcactaaagaaccagtattgttgactaatatgcttcatctttcagtttgtatggttgtaattcagtttaccacatctagtttggtgtttgatgatctgaaaaatatttcacagtgagggcaatgctcagtgcctggaagaagcagacagtctttattggtctgacaatatttgatgcaactacaagagctccatggacatgacccttgcacatttgtctgtaatacacaatgctgtaattgaattgtttcctatgttgattctctcatgtacccaagtataaaaaattggtaagtttctcttgtcttcaaagtaccattaggattttatttcctgaatttaaaatgaatattaaaatttttgtaatggcgttctttaacctgccctaaatttttatagaaaagccttgccaaatattgttgtcctcatacttaaaagtttccaca

SEQ ID NO: 80 - DNA, 672 bp, Equus caballus
  Oligonucleotide Sequence
cccattctaattaagaaagagctttcccaaaatagtctctaatttccagtttttgtaaaagaagttcgtttttggagtaaaaagtattttcatatctgtttgggggaagttaacgcatcaggaaagaatattattaggtgtttaaaccctgaaacaaacatatactgatgcataacttagtagatcaccgaaactaacttgctgaaatctttggttttgtcctgtgagaccagtgcttgacatcgtctgttcgcctgagcccagttggtggctccagtttgcttttctcttcggtctcgtggtagcagccttggtcgttttcgttggaggttggagaggagctgaggagaaagtgctcttcggggttttgattcctctgctaggacgctgcctaaaccagctcatctcaatgtcctgttgactttattattattccgggtagttgaaagaaaagaaaatggatggacgtcattaaaaccagctcaaaaatatattcttgtcagtaaagatttcttgtcgagatgtcttggattgcactttcgtggagggaaaacagtgtaaatagttaaagaatgttgataaaattgaaacatttggttatggaattgtgtgtggtgttagaaggtttctgtttgtgaaatgtctgtattaaaataataaatttcagaaact

SEQ ID NO: 81 - DNA, 790 bp, Homo sapiens
gattgttgaagcttctttaaaccatcctgagtcagttaatagaacgaattttgactgtattgaaaatggattgccttctgtgtgcatggatctgaaactctgtttctcatacaagggcaaagaggttccaggttatattgttttgttttataacatgagtctggatgtgaaccgaaaggcggagtctccatcgagattttacttttcttcaaatggaacctctgatgtgattacaggaagcatgaaagtatcaagcagagcggctaactgcagaacccatcaagcatttatgcggaaagatgtgcgggacatcctcaccccaattcagatcaaagctgcttaccaccttgggcatcacgtcatcagtaaacgaagcacagaggaattcccgccccttcagccaattcttcagcagaagagagaaaaggatgtgattgaaaaaacaataaactttgcaaggttttgtgcccatgaaaattgttctgcagatttacagctttctgcaaaaattggatttttgaagccacatgaaaataaaacctatcttgctgttggaaatatgaagacgttaatgttgaatgtgtccttgtttaatgctggagacgatgcattatgaaacgactctgcatatcaaactacccactggtctttatttcattaagattttagatctggaagagaaacaaataaactgtgaagtcacagacagctcttgcatagtaaaacttgactgcaatgttggttatatatatgtagatcatctctcaaggatagacgttagctttctcct

SEQ ID NO: 82 - DNA, 682 bp, Homo sapiens
gtaggatccatggtagaaaatcaaacccaaattcagaatcgctttctcaaagatgatccctgaggaacattagttctttcttattcagaaatgatggcatttcagattgctggataacatgactttcaggagcaagaggaacacagctcccaattaggccagattctgcccagttagatattttgcacagtttaaaataaaatttgttataaagtcttaaattacctgtattatgaattttaaaaccctaccactttaagaaaatcaactttcagagaagattcacaaaattggaaccataacttttaaaaaaaaaaagattgggtttctttttgggcaagtagtctaggtattggagagattttgaaaaaaaaaatagttctatttctggttatatcattaactagctgtgtaattttgaaatttaacctcactggattggcacctccccaggaaaatcagggcattcttatgtgaacttgtggtttgtctgtaccaggccataggaaacttaacattagaattgaaagactcaaatcctgaaaaatcaaaaaatccaaattatttcactttggaatcatctagttaaaattgatatactgatgtttaaattttaagtacctgcaatgtttactttcagttctaataaataccttctaaaaaaccaaaaaaaaaaaaaaaa

SEQ ID NO: 83 - DNA, 1473 bp, Equus caballus
  Oligonucleotide Sequence
tccttcccctcctacctgagccatgaaaagtacggagacgtccactgtcatggcagaacatgggccataaagcaaattcaacaaggggtgttctgttttaataggacctcaaccagttccatgaactgagtgaaggacgttcattttaaaagtcatttaataataagcttagttaaactctttcacctattctcccaagacctattggcattgttaaaaaccaagtatatcaaatatctaactaaggatgtagttaaccttattaaatattgattagaattgttctgtaatattactgaatttgtaagatctttagcaaagatttttgagcaatttataaatatagagcaaatgtttctgtttactgcactttttgtaattgaaggtgataaattctcaagccatggttattggcttccatgcactgcatatttacccacaattctagacagtttccatttttatggaagagttgctattaccttaatcataaatgcaatcatgtggttaatgagagctaatgctaatagttaaccttttaaagtgaattggccacagtttaggaagaaatctcttttaatacagagtatgtcattccttattgcttcacttagaaggagactgaaagctttgttttttttaagcactatttagtatcctaagcttcctgagggtagagattgtatctctttttgtctgcacaatggccagcacatgtcagcatttgatcattgttaaatgacaacaagtgttccccaattccaacttttttcctggattcttttggtaaatttataaaatatggcaagctgtatggttaacactttcttctacaaccaagtattaaagccacatttgaaaagaccacatgaaatgctgattcctaattgtgtgtaggtcttgaggattaagcacacaaatttcaccaaactctgtgagtaacaaactcagccttctgtaaatatacatgcaagtctggaaacgataatactgtacctataaatatatgctgtctgttttgtgtacagtatgtaaaaactccttttctgccacactaaaaatgcaagccatttgtgggaatcctaaaaatagtattatactaaaactttgctaatgatctttactagaggatcatctgacttttcacttacattgggttttcttttcaactcactcttacagtagtctgcttatttccagctgtttattttattgagtcctgaatttaaaaaaaaaatattttgattcattttgtaaatacaagctgtaaaaaaagagagatttaatgttgtcttttaaatactccgattttcattctaatatgaatgttgttatattgtacttagaaactgtacctttaatattacattacctttattaaaagtgcattgaacacatcaattttagatgtgctttatgtactgttatcctataataaaacttcagcttctaatggaaaaaaaaaaaaaaaaa

SEQ ID NO: 84 - DNA, 2187 bp, Homo sapiens
aaaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttgactggagtgatcctctcccagtatgtgtaattgccaagtgtgaggcccctccagccatcagcaatgggaagcacagtggtggagatgaagacgtctacacatatggctcttctgtcacctacagctgtgaccctcacttctcaatgataggcaaagcctccatttcctgcacagtggagaataaaacgataggtgtctggagcccaagccctcctacctgtgaaaaaatcacctgtcgcaagccagatgtttcacatggggaaatggtctctggatttggacccctctatacttacaaagacgctattgtgttggactgcaagaagggttatgtcctcacaggcagcagtttaatccactgtgaagctgataacaactgggaccctcctcctcctgtttgtgagctcaatggttgtaccaacttaccagacatcccaaatgccttctgggaacgatacaggtatcagaggccaacaaaagaggacgtgtataatgttgggactgtgttgaagtaccattgcctgactggctataaacctgcttcagataaacccacggctgtgatttgtcaggaagatttcaggtggactccatacacggaatgtgaggaggtatgttgcccagtaccagagctgaagaacggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcatctccagctcctcaatgtaaagctctgtgtccgaaaccacagatagagcatggacggctgtctgtggttaaggatcagtatattacacctgaaaatgtcaccatccagtgtgaccctcactatcgtttggttggtctccaaagtatcacttgctcagagaacagcacctggtaccccgaggtgcccatgtgtgagtgggagatcgctgaaggctgtgagcaagtgctcgcaggcagaaaaatcatgcagtgtctcccaaagccggaggatgtgagaacggccctggagctgtataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaaggataattggttaatgtttaatgctttgagattgtgaaattattaatcatcctctgtgtggctcatgtttttgcttttcaacacacaaagcacaaattttttttcgattaaaaatgtatgtat

SEQ ID NO: 85 - DNA, 1803 bp, Homo sapiens
  exon (1)..(1803)
atgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttgactggagtgatcctctcccagtatgtgtaattgccaagtgtgaggcccctccagccatcagcaatgggaagcacagtggtggagatgaagacgtctacacatatggctcttctgtcacctacagctgtgaccctcacttctcaatgataggcaaagcctccatttcctgcacagtggagaataaaacgataggtgtctggagcccaagccctcctacctgtgaaaaaatcacctgtcgcaagccagatgtttcacatggggaaatggtctctggatttggacccctctatacttacaaagacgctattgtgttggactgcaagaagggttatgtcctcacaggcagcagtttaatccactgtgaagctgataacaactgggaccctcctcctcctgtttgtgagctcaatggttgtaccaacttaccagacatcccaaatgccttctgggaacgatacaggtatcagaggccaacaaaagaggacgtgtataatgttgggactgtgttgaagtaccattgcctgactggctataaacctgcttcagataaacccacggctgtgatttgtcaggaagatttcaggtggactccatacacggaatgtgaggaggtatgttgcccagtaccagagctgaagaacggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcatctccagctcctcaatgtaaagctctgtgtccgaaaccacagatagagcatggacggctgtctgtggttaaggatcagtatattacacctgaaaatgtcaccatccagtgtgaccctcactatcgtttggttggtctccaaagtatcacttgctcagagaacagcacctggtaccccgaggtgcccatgtgtgagtgggagatcgctgaaggctgtgagcaagtgctcgcaggcagaaaaatcatgcagtgtctcccaaagccggaggatgtgagaacggccctggagctgtataagctgtctctggaaattgaacaactggaactacagagagacagcgcaagacaatccactttggataaagaactataa

SEQ ID NO: 86 - DNA, 5245 bp, Homo sapiens
ggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagagagtcacaaaggttctaaattgggttagagaacaacctgaaaaggaaccagagttgcagcagtatgtcccacagctgcaaaacaacaccatactccgtcttctgcagcaggtggcacaaatttatcagagcattgagttttctcgtttgacttctctggttccttttgttgatgctttccaactggaacgggccatagtagatgcagccaggcactgtgacctgcaggttcgtattgaccacacttctcggacccttagttttggatccgatttgaattatgctactcgagaagatgctccaattggtcctcatttgcaaagcatgccttcagaacagataagaaatcagctgacagccatgtcctcagtacttgcaaaagcacttgaagtcattaagccagctcatatactgcaagagaaagaagaacagcatcagttggctgttaccgcgtaccttaaaaattcacgaaaagagcatcagcgcatcctggctcgccgtcagaccattgaggaaaggaaagagcggcttgagagtctgaatatccagcgggagaaagaagaattggagcagagggaagctgaactccagaaagtacggaaggctgaagaagagaggctgcgacaggaggcaaaggagagagagaaggagcgtatcttacaggaacatgaacaaatcaaaaagaaaactgttcgtgatcgtttggagcagatcaagaaaacggaactgggtgccaaagcattcaaagatatcgatattgaagaccttgaagaattggatccagatttcatcatggctaaacaggttgaacaactggagaaaaaaaagaaggaacttcaggaacgcctaaagaatcaagaaaagaagattgactattttgaaagagctaagcgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagacgacccagggatgaaggtggctggagaagaggaccagctgaagaatcttctagctggagagattcgagtcgccgtgacgatagggatcgggatgaccgtcgtcgtgagcgagatgatcgccgtgatctgagagaaagacgagatgacagagaccgaagaggacctcctttgagatcagaacgtgaagaagcaagttcttggagacgtgctgatgacaggaaagatgagcgggcggaagagcgggacgcccctcgtcgtgttcctcccccagctctttcaagagaccgagaaagagaccgagaccgagaaagagaaggtgaaaaagagaaggcctcatggagagctgagaaagatagggaatctcttcgtcgtactaaaaatgagactgatgaagatggatggaccacggtacgacgttaagtctcaagataatgggttcgaactcatgtgtcacataggtttgatcacattcgcggattattagacttgtgcttcaaccagtctaaattggattctttaatgttgtctcaccataacacaaaaagcatgaacttgtattaatcctatataatagattgatcatgcaccgtatccacagaaagctggaaaaccatgccattttctggaatttaaggtgttgcattatttcatcaatcatttgttgacaaaaaagaaaaactaaaaaataaatttaaaatgtgaaccttcaggtattgagtaacacctttatcttggtatagaactgataccattttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaaa

SEQ ID NO: 87 - DNA, 4140 bp, Homo sapiens
  exon (1)..(4140)
atgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagagagtcacaaaggttctaaattgggttagagaacaacctgaaaaggaaccagagttgcagcagtatgtcccacagctgcaaaacaacaccatactccgtcttctgcagcaggtggcacaaatttatcagagcattgagttttctcgtttgacttctctggttccttttgttgatgctttccaactggaacgggccatagtagatgcagccaggcactgtgacctgcaggttcgtattgaccacacttctcggacccttagttttggatccgatttgaattatgctactcgagaagatgctccaattggtcctcatttgcaaagcatgccttcagaacagataagaaatcagctgacagccatgtcctcagtacttgcaaaagcacttgaagtcattaagccagctcatatactgcaagagaaagaagaacagcatcagttggctgttaccgcgtaccttaaaaattcacgaaaagagcatcagcgcatcctggctcgccgtcagaccattgaggaaaggaaagagcggcttgagagtctgaatatccagcgggagaaagaagaattggagcagagggaagctgaactccagaaagtacggaaggctgaagaagagaggctgcgacaggaggcaaaggagagagagaaggagcgtatcttacaggaacatgaacaaatcaaaaagaaaactgttcgtgatcgtttggagcagatcaagaaaacggaactgggtgccaaagcattcaaagatatcgatattgaagaccttgaagaattggatccagatttcatcatggctaaacaggttgaacaactggagaaaaaaaagaaggaacttcaggaacgcctaaagaatcaagaaaagaagattgactattttgaaagagctaagcgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagacgacccagggatgaaggtggctggagaagaggaccagctgaagaatcttctagctggagagattcgagtcgccgtgacgatagggatcgggatgaccgtcgtcgtgagcgagatgatcgccgtgatctgagagaaagacgagatgacagagaccgaagaggacctcctttgagatcagaacgtgaagaagcaagttcttggagacgtgctgatgacaggaaagatgagcgggcggaagagcgggacgcccctcgtcgtgttcctcccccagctctttcaagagaccgagaaagagaccgagaccgagaaagagaaggtgaaaaagagaaggcctcatggagagctgagaaagatagggaatctcttcgtcgtactaaaaatgagactgatgaagatggatggaccacggtacgacgttaa

SEQ ID NO: 88 - DNA, 3701 bp, Homo sapiens
ggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattaaccagcttcagcagattatgcgtctgacaggaacaccccccgcttatctcattaacaggatgccaagccatgaggcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgatggtgggaggtagaattgaccatatcccccagcggcacagagagaaggcgcacaccttctggctgcttcagatctgaagccgtccatcagcgatgcatacagccaaaaaggaccaactggcttctgtgctctagtctatgattaacttgcttaatatgattctcagaactcaacaggtgtatctgaaactgtaaatatgtttgtgccttaaaaggagagaagggagtgtagagagttaagagagtgcagcagatgaagttctgagccaggcgcgtcgtcaggttgtcggacggctacttgtgaagctgaagtaaccagggagccttcagaggcgccgtgtatgcatgtgtgagcatgcgtatatgtgcttctctctctttcttcctcgccccccaggtggtgttgccgtttctctgcttacccccaccttcagtgcagaggtttcttgagtattggccccggtagtcagaagccggttcttgctgtcagtgtacttcctgtgtgctctttattcctagcagagtgacatgtgttttgcacgtcttgctatttgagcatgcacagctgctgtcctgttctcttcgggaggccctggtgccaggcaggtttgccagtgaagactttttgggtagttcggaacccatgtcaccttggctcatgctttgggcaggtgacatcatcctctcttcagcccccagtgctattttgtgttgaacacaattaatactccaggtgcttttgatgtgaaaactatgaaaaaatggaacagatggacatatagcattttcattcttgccatctggtttttcaacaaactatttttggggagctgtcatgggaaagatcagggcttttcctaggaatatctcaaattttggaaaacaaattgttctcttccctcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatccctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagctacttccagtgttggctatgtgacagaatcttgtatttgggccaaggtgtttccatttctccatcacagtgcggtgatgcatgcgctccagaggggcaggtaggaccctgggtcaactggagtgagaaggaacaggcagactgatggcgattccctctcacccgggactctccccctttcaaggaaagtgaacctttaaagtaaaggcctcatctcctttatatgcaggtcaaatcctcacgatgcacagcaagatgaattttatcggccatgtttggttgtaaatgctagtgtgatttcctacagaaatactgctctgactattttcataaaggtctttgcacatgtgaccatatctgtgttaggaggctgaatgctccgggagcctgaactcagctggagcctgtggaagagctccttggtttctgagcatcacgctcccatctcctgatttctctgaacggaaaacagaagagagaatgagggatactgctatgttatttgtactcatgaacttggctgtaatcagt

SEQ ID NO: 89 - DNA, 1083 bp, Homo sapiens
  exon (1)..(1083)
atgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattaaccagcttcagcagattatgcgtctgacaggaacaccccccgcttatctcattaacaggatgccaagccatgaggcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctga

SEQ ID NO: 90 - DNA, 2441 bp, Homo sapiens
gcagccgccaccgccgccgccgccgccaccagagccgccctgtccgcgccgcgcctcggcagccggaacagggccgccgtcggggagccccagagcacggtccccacctcagtatgatggacttggaggtgccgccgcccgcacagccgtcccagcaggacatggatttgattgacatactatggaggcaagatatagatcttggtgtaagtcgagaagtatttgacttcactcaacgactacagcatgagctggaaaaacagaaaacacttgaaagacaagaaagacaagaacaactccaaaaggagcaagagaaagcctttttcgctcagttgcaactagatgaagagacaggtgaattcctcccgattcagccagcccaacacatctcatcagaaaccagtgggtctgccaacttctcccaggtttcccacattcccaaaccagatgctctgaacttcgatgactgcatgcagcttttggcagagacattcccgtttgtagatgacaatgaggtttctccagctacgtttcaatcacttgttcctgatagtcccagcaacatcgagagcccagacttcattgctcctaaccaggcccagtcacctgaaactcttgtccttcagccagccgttgctgattcagacaatatgcagcaggaccttgagcaagtttgggaggagctattatccattccagaattacagtgtcttaacattcaaaacgacaagctggttgagactagcacggttccaagttcagaaaccaaagtgacagaaattgacaacaattaccatttctactcatcgatcccctcactggaaaaagaagtaggtaactgcagtccacagcttctcaatgcttttgacgattccttcagcagcatcctctccacagaagacaccacccagttgacaatgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctattgaaaaaacgactcagcaccttgtatctcgaagtcttcagcatgctacgtgacgaagatggaagaccttactcccccagcgaatactccctgcagcagacgagagacggcagcgtgttccttgttcccaaaagtaagaagccagatgttaagaaaaactagatttaggaggatttgaccttttctgagctagtttttttgtactgttatactaaaagctcctactgtgatgtgaaatgcagaaatatactttataagtaattctatgcaaatttatagtcaaaactagtgtagaaaatataaaactttaaaaagcattggagtgtcagtatgctgaatcagtagtttcactttaactgcaaacttaatttcttagaacaccatttgggctagtttctgtgtaagtgtaaatactacaaaaactttatttatactgttcttatctcatttgttacgttcctagatttatatgatacatctggctaaaaagcaaattgttgcaaaactaaccactatgtacttttttataaatactgtatggacaaaaaatggcattttttatattaaattgtttagctctggcaaaaaaaaaaaattttaagagctggtactaataaaggattattatgactgttaaaaaaaaaaaaaaaaaaaaaaaaaaaaaaaaaa

SEQ ID NO: 91 - DNA, 1821 bp, Homo sapiens
  exon (1)..(1821)
atgatggacttggaggtgccgccgcccgcacagccgtcccagcaggacatggatttgattgacatactatggaggcaagatatagatcttggtgtaagtcgagaagtatttgacttcactcaacgactacagcatgagctggaaaaacagaaaacacttgaaagacaagaaagacaagaacaactccaaaaggagcaagagaaagcctttttcgctcagttgcaactagatgaagagacaggtgaattcctcccgattcagccagcccaacacatctcatcagaaaccagtgggtctgccaacttctcccaggtttcccacattcccaaaccagatgctctgaacttcgatgactgcatgcagcttttggcagagacattcccgtttgtagatgacaatgaggtttctccagctacgtttcaatcacttgttcctgatagtcccagcaacatcgagagcccagacttcattgctcctaaccaggcccagtcacctgaaactcttgtccttcagccagccgttgctgattcagacaatatgcagcaggaccttgagcaagtttgggaggagctattatccattccagaattacagtgtcttaacattcaaaacgacaagctggttgagactagcacggttccaagttcagaaaccaaagtgacagaaattgacaacaattaccatttctactcatcgatcccctcactggaaaaagaagtaggtaactgcagtccacagcttctcaatgcttttgacgattccttcagcagcatcctctccacagaagacaccacccagttgacaatgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctattgaaaaaacgactcagcaccttgtatctcgaagtcttcagcatgctacgtgacgaagatggaagaccttactcccccagcgaatactccctgcagcagacgagagacggcagcgtgttccttgttcccaaaagtaagaagccagatgttaagaaaaactag

SEQ ID NO: 92 - DNA, 777 bp, Equus caballus
  Oligonucleotide Sequence
ggaccttaccttcaagcaccaatgagagctcagaatggaggaaaaaactatgaacggaaggaatgttcaagatcttttattcattccgcaagcctcggtgcgcatgtacaaactcacactgctaacaaccattacaaatgtaaggaatgcagaaaatcctttaaacgatctgcataccttaacgctcatgttcgaattcacactggaagaaaaccctttaaatgtaaggaatgcaggaaaggctttaaacgttctatgcaccttaaggttcacatgcgaacccacactggagagaaatcctatgaatgtaaggaatgtgggaaaaccttcactcaatcctcaggcctcatttaccacaataagattcacactggagagaagccttttaaatgtgacacatgtgggaaagcctatgctagtttctcaaatcttactgcccattttagaactcacactggagagaagcgttttgagtgtaatgtatgcaggaaaagatttagcagttcctcatacttagtcgttcacaaccgcactcacactggagagaaaccctataaatgtgaggaatgtgggaagggctttaaatgttctgtgtcccttaaagttcacatgcggtttcacactggagagaaaccctatgaatgcaagaaatgtgggagagccttcactcagtcctcaagccttactgaccataggaaaactcatactggagagaatccttttaaatgtgacgcatgtgggaaagcctttgctctttcctcacatcttaacagacat

SEQ ID NO: 93 - DNA, 589 bp, Equus caballus
  Oligonucleotide Sequence
gcctattgagtgtaatgtatgtgggaagacatttagcagttttttgtacttgatcgttcacaagcgtactcacgctggagagaaaccttagaaacgtaaagaatgtagggaaagccttcagttttcccatttccttttggtaccatgaaagcacttacctgcagagaaatcctgtcagtgtaaagaatgtggtaaagccctcagttgtcccaattcactttgaagacgtgaaagaaccacactggagagatgctctagaaatgtaaggaatgagggaaagccatgagaatctcatcacaacctggcatgtatggactaacagtgaaagcataccattaagaaacatgggaagcccttcactgtttcctcagtgaaatatatttatttttataaatgagacaccttgtaatggagagaaatccaagtggtgtaatgtgggaaaattgttctagtaatgttcacttgttttttgtgtggagaaaaactttatgaatgtaagaaatgttgtatagtcattatcatttttcgtaagattgtttctcttccttaataaacgtatggtaattcaaattaaaaaaaaaaaaaaaaa

SEQ ID NO: 94 - DNA, 2776 bp, Homo sapiens
gtggtgcacgcctatagtctcagctactcaggaagttgaggcaggaggatcgcttgagcccaggagtttgatgctgcagtgagctatgattgtgctaccactgtactccagactggacaaaagattcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggaaaaaaaaaaaaaaaaaaaaaaaaaaaaaaaaaaaaaaaaaaaaaaaaaaaaaaaaaaaaaaaaa

SEQ ID NO: 95 - DNA, 2373 bp, Homo sapiens
  exon (1)..(2373)
atgattgtgctaccactgtactccagactggacaaaagattcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctga

SEQ ID NO: 96 - DNA, 1721 bp, Homo sapiens
gataaagataagttttactgtcatgctgcttttaacataacagagcaacatcacctaggaaaaaagtttgtaggaggatttttaatccatacacttgccttatgattacattaagatttctttgagaaaagaagcatgtcaggaagctctggatgccctttttctgtctgggcaattctggccttcttgggtttagctcttgttgtatcgctgatcttcaatatttcctgctatgtggaaaagcagcgacaaggtataacatacaggttctctgatgactacatttcccgggaggatgagtattacattgaagacacacccatttatggtaacttagataatgtgatcccagaaccaatggatgaaaactgctatgagcaaatgaaagcccgaccagagagatctgtgaatcaactgcgagcagctcccacacctgcacaggcaaccaatgaagcacagatgttctactcctccctggagcacagccttgaggggaagcgcagaaagcccaggaaacacgatccttatttgccagacaaggttgaagatgagcagttacacgcgacggatgccagcctttctatgactgctttggttgatagttttgcacctgaggaccaggaagaagaggaaaacatccatgatgatcccatcaggctgttcggattgattcgtgcgaagaaagaacctatgaactagctggactctgatctagctcaatgattcagctcttattggagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcaaaaaaaaaaaaaaaaaaaaaaaaaaaaaaaaaa

SEQ ID NO: 97 - DNA, 564 bp, Homo sapiens
  exon (1)..(564)
atgtcaggaagctctggatgccctttttctgtctgggcaattctggccttcttgggtttagctcttgttgtatcgctgatcttcaatatttcctgctatgtggaaaagcagcgacaaggtataacatacaggttctctgatgactacatttcccgggaggatgagtattacattgaagacacacccatttatggtaacttagataatgtgatcccagaaccaatggatgaaaactgctatgagcaaatgaaagcccgaccagagagatctgtgaatcaactgcgagcagctcccacacctgcacaggcaaccaatgaagcacagatgttctactcctccctggagcacagccttgaggggaagcgcagaaagcccaggaaacacgatccttatttgccagacaaggttgaagatgagcagttacacgcgacggatgccagcctttctatgactgctttggttgatagttttgcacctgaggaccaggaagaagaggaaaacatccatgatgatcccatcaggctgttcggattgattcgtgcgaagaaagaacctatgaactag

SEQ ID NO: 98 - DNA, 1380 bp, Bos taurus
gtgaggacagcagctttgagagcggttctgaagctgaatctgcccatgtcactgatattgctcgaggacatagtaattacaagtgtccttttggtgaagtaccgaagagtacttatatggatagcggctgtggaataaggttgaaagattttctggtgcaggacttggatcggtgtttcagaaccttcagatctatggggtccccaacccctgggccactgtctggtaccattaggagccgggccacacagcaggaggtgagcggtgagctagcgagcaaagcctcatctgtatttacagccacttcccgttgcttgcgttaccgcctgagtgccacctcctgtcagagcagcggtgggacaagattgtcatgggaatacagaccctactgtgaactgcccatggaactaggttgcccactcgggaaacacaatgaactggtgacccccaggcttctttcccgaggacagtttttgctgaaggtggatggagagggaacttaccagtgcacggagactggtctgatatttgaggttaacgggaaagttgatatcaagtattgcgtcttgtcctggagcaaatattcagacctcattgtgaagccctgggccgtcggtggacccttgtttgatgttaaatgtgacccgctctgtcttacctccattcagtttccacattccctctgcttgggtcaccgagatgccaacatgacgttcaaagtcttccatgttaaaagtactggggcctcattagaatatactgtggaccattctgcaacccacgtcaaatggcgtgtgagctctctttctcctgtgggacccgttgttcaaagcgaagagacggtattccaccacggggcagtgattctgtacaaagccatcgaccataacccgtccttgtcttttcgagtgtatgtagcaaccaataatgaatccttcatcaaggatatttccaagtctgtaaagcactcctctaagaaattcatgaaaatcgacaagcctccggtttgccagaagttgctgcagaatgggaagaagtacaggctgatcagtgagccagaagctgagatcaccccagaggaaattgaatttgtggatggttcacttttaaaattgaaaagttatattgaagtgtatctggagcaaccagtggagtttaaattactcttggttgaaatggattctgaggaaattgtatggaaagcaaaactgagagagtgtgactgggttcagcatcatcagaaccagaacatttcaaaaagcagcacaagtggtaacaggcgacgaaaaatgagtagcagcttacctgatgagatggtctatgataaaagaatgaagcagattgacagttcaggtttgtaaacatgtcctctgtggctct

SEQ ID NO: 99 - DNA, 1359 bp, Bos taurus
  exon (1)..(1359)
gaggacagcagctttgagagcggttctgaagctgaatctgcccatgtcactgatattgctcgaggacatagtaattacaagtgtccttttggtgaagtaccgaagagtacttatatggatagcggctgtggaataaggttgaaagattttctggtgcaggacttggatcggtgtttcagaaccttcagatctatggggtccccaacccctgggccactgtctggtaccattaggagccgggccacacagcaggaggtgagcggtgagctagcgagcaaagcctcatctgtatttacagccacttcccgttgcttgcgttaccgcctgagtgccacctcctgtcagagcagcggtgggacaagattgtcatgggaatacagaccctactgtgaactgcccatggaactaggttgcccactcgggaaacacaatgaactggtgacccccaggcttctttcccgaggacagtttttgctgaaggtggatggagagggaacttaccagtgcacggagactggtctgatatttgaggttaacgggaaagttgatatcaagtattgcgtcttgtcctggagcaaatattcagacctcattgtgaagccctgggccgtcggtggacccttgtttgatgttaaatgtgacccgctctgtcttacctccattcagtttccacattccctctgcttgggtcaccgagatgccaacatgacgttcaaagtcttccatgttaaaagtactggggcctcattagaatatactgtggaccattctgcaacccacgtcaaatggcgtgtgagctctctttctcctgtgggacccgttgttcaaagcgaagagacggtattccaccacggggcagtgattctgtacaaagccatcgaccataacccgtccttgtcttttcgagtgtatgtagcaaccaataatgaatccttcatcaaggatatttccaagtctgtaaagcactcctctaagaaattcatgaaaatcgacaagcctccggtttgccagaagttgctgcagaatgggaagaagtacaggctgatcagtgagccagaagctgagatcaccccagaggaaattgaatttgtggatggttcacttttaaaattgaaaagttatattgaagtgtatctggagcaaccagtggagtttaaattactcttggttgaaatggattctgaggaaattgtatggaaagcaaaactgagagagtgtgactgggttcagcatcatcagaaccagaacatttcaaaaagcagcacaagtggtaacaggcgacgaaaaatgagtagcagcttacctgatgagatggtctatgataaaagaatgaagcagattgacagttcaggtttgtaa

SEQ ID NO: 100 - DNA, 874 bp, Equus caballus
  Oligonucleotide Sequence
gctgcgaagctcctttacattgggtctgtaagaaggtcagactttgacagatggtcagatctgtcatatgactcccttaaaagggggagctggcctctgggtgttgggatagccatgagtatatatatatatatatatagtgaatgctgaacctttgaggatatggcattagatgcaagattaaatgcagcttccccagggttgatggtttattggtggactttgagagtatttagatattatcttaacaatttaaaaaccagatctaggcaaatttgtgaaatagataaagttttttttagtatttttcactctagtgactaatgctgcttccttcatcctcacccccaccatctcagtcaaaaatataccttttatatgctatattctgagctgatctaatgaaatctgtgcaaatatatactattgctaatgtagcagagggtttttatgtgcattaatgggttgacatgttacttttctctgataatatatttttatcctaacagtggccctttgcagataaagcattattctaaagaataatgctaatggtgagaaaataaattatgaaagtagatgagagcagggtgatgctgtctggtcttcagctcttcacacttacttaagacctggccttgactgaatttagtttttctgaatatgcgtagatgtggttgaatgaaacaatgtgtgactatattttttccatgttgtgaacatgtgatttgcatgttgattttacaacagtggtctctttgacaaggcatttttgtagaggaaaatttacggaagcagtttatgtggttcattctcaaattattttaggcactaatgccctcaaaaatgagaaaaacttattaatttttcttta

SEQ ID NO: 101 - DNA, 685 bp, Equus caballus
  Oligonucleotide Sequence
gggtttttatgtgcattaatgggttgacatgttacttttctctgataatatatttttatcctaacagtggccctttgcagataaagcattattctaaagaataatgctaatggtgagaaaataaattatgaaagtagatgagagcagggtgatgctgtctggtcttcagctcttcacacttacttaagacctggccttgactgaatttagtttttctgaatatgcgtagatgtggttgaatgaaacaatgtgtgactatattttttccatgttgtgaacatgtgatttgcatgttgattttacaacagtggtctctttgacaaggcatttttgtagaggaaaatttacggaagcagtttatgtggttgattctcaaattattttaggcactaatgcctcaaaaatgagaaaaacttattatttttctttagtaggatttggacatagataaggagggaagatgttgtttaaacatattggagggagtaatgaaagggacgatacttcttactgttgttgacgctggattgtagtctgtttacttgtctttctctttcgtagtttttaaggacgtggactgtatcttatccaccattgtatctcagacacctaaaatagtgtttgtatcaatgaatattaaataaatgaatggattaataaaaaaaaaaggggggcccgtacccat

SEQ ID NO: 102 - DNA, 926 bp, Equus caballus
  Oligonucleotide Sequence
gttaaacattatttccttaaaaaaatttatttttacatgaaaacaaaatatatttggagtgtacttccatcaaaaatttcacttctatatctgaggtctacttatttcaaagtaaaaattttcacttgtcagctgaaatttctgattagaactaatatttgtgtatttttgtgcttagtcagaatgtaaatttcacagtggatttaaatttatccttaatttggataaaagcaagggatatatttaaaagttattatagggatgaaagtggaaatttctgtttttggtttttttttaactactaatgagatcacgtttgtagttctttttacatgtgtttagcacaggctctaaattaaaaaatacagtatagtctgtgttgaccttaaaaatattccataaattaataaatatatggcaagtttttcatagctaaatctaactcttgtagaaggaagctgtgccttctgtttaattacattaattgaaatgtgtttaagagaaatgttttcagcatattttgtatactaaaaaacaaaaaggattagtattgggccaatggccaagaggtaatattactaccatgtagactgttacagttcaaattgtcccacttcccccagagttttagaagctagaagtctgggagatactgtatcagctgtagttgggtgattctaagtgctataagtactattcatcttttaattgtgtgagatggaacaaatgccaagttgcacaagatgcatactttgaatatgtaatggtttgtttcaggtgaaaaataccagcaagtcatgtcttgtgtattttacttatatttccttgtaaaactaaattaagtaagattttggaaaatgatttgaattgattgctgacttgacctgcctggtcaaatatctgaatgatggccttactgggtaaat

SEQ ID NO: 103 - DNA, 650 bp, Equus caballus
  Oligonucleotide Sequence
aatattactaccatgtagactgttacagttcaaattgtcccacttcccccagagttttagaagctagaagtctgggagatactgtatcagctgtagttgggtgattctaagtgctataagtactattcatcttttaattgtgtgagatggaacaaatgccaagttgcacaagatgcatactttgaatatgtaatggtttgtttcaggtgaaaaataccagcaagtcatgtcttgtgtattttacttatatttccttgtagaactaaattaagtaagattttggaaaatgatttgaattgattgctgacttgacctgcctggtcaaatatctgaatgatggcattactgggtagattctaacccatgattctaactgtggaataaagagtagtatagaccgtaaaactatgttcaggcacttactcttcgtttatattatgtattaccctctatcataacacacttattgaatttccaagttgaacagttctgtaactattgttgctattcatgtaataaaacatgcttatgatagtaaaatgaatagaagtgcccccaaatgctattttttttaattcacttgtaactgttactcttgtaattgtgtatgacataaaatttgtaaaaattttagcatgaaaaaaaaaaaa

SEQ ID NO: 104 - DNA, 4195 bp, Homo sapiens
  Oligonucleotide Sequence
gagagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatataaaaaaaaaaa

SEQ ID NO: 105 - DNA, 2025 bp, Homo sapiens
  Oligonucleotide Sequence
  exon (1)..(2025)
atgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaa

SEQ ID NO: 106 - DNA, 860 bp, Equus caballus
  Oligonucleotide Sequence
ggatagtgcagcatcctagagctttggtgtcacacagacccaggttcgagtcttcactttgccacctcttgcctgccgaggggctgtgagctgaatttcctacctcatagggttgtaatgagcagtggatgctgaagcagacacctcttggtcaaggtgactgctcatcccagattctccctttttctgagaatttgttcccctcagtcctcatataggagctgaatggatgagaggcgagcatctggctgtacttgggccagtctggttctctctctcaggaataagcagcgagactcagggatgctgtttccagctctgcaagtcacttacctgaagatatacaaactctggagctgtgagcgtgtgtctacatgtgtgtctctatgtacccaagccttgggggtggtggcggcagggggtggccacctgcatgagtgtattagagaaaatggctcgactcagagagaagatggagatgtgcagagcaaatcagagaccagagggagaccccaggagcctggagaggccagggggaggcgcttcccggagcctgccggcgctcctcctctgggccaaacccttctcgagcctcaaagtccgccctccttcctttgagtcctgtgagatgcccttgttaggatgcattctcttgttttgcttgagctgatttgaagtattatctattacttgcaaccaaaagagctctgaataagataaaatcttgttgctaaagcacagtgtctctcgaatttcggtcatccctgtaccctcctcacaatttttgcatatctatgtaccatctgtatgttttactaataaatattgttctttaaatctttaaaaaaaaaaaaaaaaaa

SEQ ID NO: 107 - DNA, 2131 bp, Equus Callabus
cccccgccgccgggaccgtcagccgcgcgccgccttcgccatggagcagctgagcacagccaacacccactttgcggtggacttgttccgcgctttgaatgagagcgatcctactggaaacatcttcatctctcccttaagcatttcctcagcgctggccatgatctttctggggaccagaggcaacacagcggcacaggtgtccaaggcactttattttgatactgttgaggatattcattcaagatttcagagtctgaatgctgatatcaacaaacctggagctccctatattctgaaactcgctaatagattatatggagagaaaacctataatttcctcgctgatttcttagcttcaactcagaaaatgtatggtgctgaattggccagtgtggattttcagcaagcccctgaagatgcaagaaaggagataaatgaatgggtcaaaggacagacagaggggaaaattccggaactgttggtcaagggtatggttgataacatgactaaacttgtactggtgaatgccatctacttcaagggaaactggcaggagaaattcatgaaagaggccaccagagacgccccattccgattgaataagaaagacacaaaaaccgtgaaaatgatgtatcagaagaagaaatttccatacaactacatcgaggacctcaagtgccgtgtgctggagctgccttaccaaggcaaagagctcagcatgatcatcctgctgccagacgacattgaggatgagtccacgggcctggagaagattgagaaacagttgactttggaaaaactgcgtgagtggaccaaacctgagaatctgtatctcgctgaagtcaatgtccacttgcccaggttcaagctggaagagagctacgatctcacctcccatctagcccgcctaggtgtacaagacctctttaacaggggcaaagctgatctgtctggcatgtcaggggccagagatcttttcgtatcgaaaattatccacaaatcctttgtggacctgaatgaggagggtacagaggctgcggcagccacagcaggcacgatcatgcttgccatgctgatgccagaggaaaatttcaatgccgaccatccattcattttcttcattcggcacaatccctcagctaacatcctgttcttaggcagattttcttccccttagagaaggtggaagtacaaggtgaagcttaagcttagagctttattacctgctagtattattaccattacttttaatagtgacagttttcatatatctttaccaataaaactactatccaaaaacaaatctttaatttcctttgtaagttcagctctattggctgttgcaccccttaactttggcgtttttttatgttgaaaaaatctagttattgcttttggatgcatcaagttaaaaaataaaaagactaaatcaaatttatagattcttgataatgcagtaagctatgaaactactatactctcctgatagtggtgggaaacattatagtactgtaatttattttacagatagacttttggaagccataatagagagacgctctgattgttgaaggaaggcttaaaaacagatattcaattgaaatatagtaaagcaccccaattaaggcctgggttgtgcagacaaactcgtcttgaccgttgtttctaaccctttgttccacagggttagtgtcctagggcagcactccaatttcaaactgttagccacctggtgataccccgccttctcttttttgttctcctttatcctacctgacatgtattttgtgtaggatcacatggggtcagaaagtaggtgttctatcataaaagataccaagaaacgacaaaaaggaaaatgcggtaggagagactgttaagcaaaggggcacaaagatctcactgttacccagcttcttgcgttttctgatgaaggctcttgccttccattgtctggtaaggttgttacaccagtgcgatggctttatgcaatgttgtggtgggagatgggggggttcttttattaatataaacctttgtcaaatgtttgaatggggctgaaaatgctgcattttcttgctcccacaaagctggtatgctggttaataaagtttcctaagattctgca

SEQ ID NO: 108 - DNA, 1140 bp, Equus Callabus
  exon (1)..(1140)
atggagcagctgagcacagccaacacccactttgcggtggacttgttccgcgctttgaatgagagcgatcctactggaaacatcttcatctctcccttaagcatttcctcagcgctggccatgatctttctggggaccagaggcaacacagcggcacaggtgtccaaggcactttattttgatactgttgaggatattcattcaagatttcagagtctgaatgctgatatcaacaaacctggagctccctatattctgaaactcgctaatagattatatggagagaaaacctataatttcctcgctgatttcttagcttcaactcagaaaatgtatggtgctgaattggccagtgtggattttcagcaagcccctgaagatgcaagaaaggagataaatgaatgggtcaaaggacagacagaggggaaaattccggaactgttggtcaagggtatggttgataacatgactaaacttgtactggtgaatgccatctacttcaagggaaactggcaggagaaattcatgaaagaggccaccagagacgccccattccgattgaataagaaagacacaaaaaccgtgaaaatgatgtatcagaagaagaaatttccatacaactacatcgaggacctcaagtgccgtgtgctggagctgccttaccaaggcaaagagctcagcatgatcatcctgctgccagacgacattgaggatgagtccacgggcctggagaagattgagaaacagttgactttggaaaaactgcgtgagtggaccaaacctgagaatctgtatctcgctgaagtcaatgtccacttgcccaggttcaagctggaagagagctacgatctcacctcccatctagcccgcctaggtgtacaagacctctttaacaggggcaaagctgatctgtctggcatgtcaggggccagagatcttttcgtatcgaaaattatccacaaatcctttgtggacctgaatgaggagggtacagaggctgcggcagccacagcaggcacgatcatgcttgccatgctgatgccagaggaaaatttcaatgccgaccatccattcattttcttcattcggcacaatccctcagctaacatcctgttcttaggcagattttcttccccttag

SEQ ID NO: 109 - DNA, 860 bp, Equus caballus
  Oligonucleotide Sequence
cagacctgtcctggattcccacccactcttcttacacttcttgcaaaatgatgacgcatcacttggttctctgccacccagttttaggactggcactccacaaatgatgctgactttgtatggaaggatttagctgaaaaaaagcccagacattatcactataactagcccagctggttcttttctttcattttataaaaagaatcatttaaaagcattaattaaaatttatttctataattaaatttgtgttggtattgccagcaaaataattgaagccccaaggctcttgtcttttttaaaagcaaattaaaatattttgaagatggtgtctttaaaaagagaggttagatcagacactaaaataacagtgcctttcaccttgaggcatggcactggctatgtgaccttcaccacctatattctgtagcctatcagcaaagcaaaggaaacctctctttttaaagtgctacagcaatgcatcaatatttatgtagcaattccatcccgtaatgcatgactgtcctgaaaacactgacagccaccattggcagacacaactttccatcctgttccagccacctcagggagtctgagccatgtcaccatgaatatcccaggacgtgaggacacgttaaaggtaatcaaattagatgtttaccagatgagctcatcatgattattctcttggtaactggtaagaggaaaaattttaagtgtatacccagcccaaactaaatgaattcacagggctttcagcagaaaggctgctcaaaagcacgaagccagagtgcggagcacctgtgtgtgcatttccgctcattccagttgtttccatttttttctcctaacaccttctt

SEQ ID NO: 110 - DNA, 692 bp, Equus caballus
  Oligonucleotide Sequence
gacttgtcacatctcatggagacactcagaggtgcctgggctgggtttggctgtaggatgggctttggtatgacagacaagaccagtgaacttgtccttgccagatggggtccctaaaacagatttttatttccgcaatcaagctggaaacaagctgtgccttcaaaaaagtggcttttctaactttagttttatgttaagtatgctactaacttaaaaataagtgcattctcctcagaggaaactatttctaacatctggtgatgtgtaactcagcagtgagttgcctgtggctgtcttttcttgtattctgtaggaaaggagacctgaatttaactcaggtggcaagaaaaaaaatactaagtgctttttaatttctctaacttctttttgtgaatatgtaattttaagtgtacactacaccaacttagtaaaactcttatattttgcctatgtaggccttttctgcagaatttttaaagttaccaatgtctttaagcatcttcagctctgatcaatgaaatgtcttgcatatggaatgatgagctagtcattggaagtgctcatgggagggggctttttgttcagtctgtatcagaacagcgtttgtgctccatgccttcaactcaacaaatgaccataatccataaaataaaatgtgaagtttttaaatcagaaaaaaaaaaaaaaaa

SEQ ID NO: 111 - DNA, 1714 bp, Homo sapiens
gcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcctgctccccaaaacccgaagattcgcctctacaacgctgagcagcttctgagctgggagccggtgccccctggcaatggcacggggccggtggtctaccacgtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacggtaccttggttccagcactttcggaatgttaccattgggcctccagaaaacatttgggtgaccccaggagaaggctcccttatcatcaagttgtcccctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtcaaggcacaactactttggacaatgctaaacatctctagacccgggcatttaagcagcatatcttgctacgaaacgatggcagatgcctccaccaagcttcagcaagtgattctcatcgcctttggaacctttctgttgctgttcgcgatggcaggggcctgtctcttcctggtcctgaaatacagaggcctggttaaatactggtttcattctccgccaagcatcccattacagatagaagagtatttaaaggacccggctcagcctatcttagacgccttggacaaggacagctccccaacggaagatgcctgggactctgtgtctgtcgttgtgtttccagagaaggagtaagaagatgttctccaaagcactttgaagcaaagcattggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagcttttttttttttcttaaagaattttcaaaatcaaattccagaatgattctacagagatctctcagaataattaagatttctcttaaacactaaacaagcatgtaattatttgttagcaaaatggctctggcacacctgtgatattttgttcattgtcggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaaaaaaaaaaaaaaaaaaaaaaaaaaaaaaaa

SEQ ID NO: 112 - DNA, 990 bp, Homo sapiens
  exon (1)..(990)
atgcgaccgacgctgctgtggtcgctgctgctgctgctcggagtcttcgccgccgccgccgcggccccgccagaccctctttcccagctgcctgctccccaaaacccgaagattcgcctctacaacgctgagcagcttctgagctgggagccggtgccccctggcaatggcacggggccggtggtctaccacgtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacggtaccttggttccagcactttcggaatgttaccattgggcctccagaaaacatttgggtgaccccaggagaaggctcccttatcatcaagttgtcccctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtcaaggcacaactactttggacaatgctaaacatctctagacccgggcatttaagcagcatatcttgctacgaaacgatggcagatgcctccaccaagcttcagcaagtgattctcatcgcctttggaacctttctgttgctgttcgcgatggcaggggcctgtctcttcctggtcctgaaatacagaggcctggttaaatactggtttcattctccgccaagcatcccattacagatagaagagtatttaaaggacccggctcagcctatcttagacgccttggacaaggacagctccccaacggaagatgcctgggactctgtgtctgtcgttgtgtttccagagaaggagtaa

SEQ ID NO: 113 - DNA, 949 bp, Equus caballus
  Oligonucleotide Sequence
ttcctgaagctttgtctgatgaatgtcttccattcttcaaagtttctctgttttaactacacaacttgatttgccacatcatcagtgtctttatttctttagttctgtatttctttgcaatgtcagaaagtcatacatctgtgattctcttggtgtttggaacctgcttggaggtgtagtaaaaagtcataaagcagagaatagagtcagaatcaccagtaacttctttgctgcagtgtgaacatgccagtggtttcactctagcatggagtgttattttcctaagatcaagtgaataagagaagtaatcatgcatgcctccaccttgcctgaaatgggaatgccttagtgaatgtagtgttgtgtggtgtgtgcgttctttcacatatatgcgtacgcacatacgtatatatgcatatatttcaatcacaagcgctgctgatactgtggtttagagcagccagtagtactggtttttgaattcttgagaagagaaattaagtgacacaaatcattatatcacctgcctccagctgtagctgaacagatgccagcattataaatgtcacacctttctttaccactaaacatttgccttcaacagggcaacagtgagcttttcctatatattatggtaagttatcagaaattacagtttaaaaatattttcacatttcctgaagtttgaggcagtctaaacatgacattttaggtcttcattagctttgtttaaataacattttgcccttatcaaagcttgctcttgtcttagatataaattggaagtttcctgaatgcaaatctaagatgccaaattcttgttttccagaattaaaaaaaactgtttaaaaattgcagtcattaaaatattgattgtttttcagctttatcataatttttacttcctatagaaaaatgtttattaagaaaaatttaatttttctttttc

SEQ ID NO: 114 - DNA, 614 bp, Equus caballus
  Oligonucleotide Sequence
ttgttactcaaaattgcggttctggactttgtttttattagttgcttgattgatttttagtcttctgaataatagtgaaaatatcggtaaggtgtgaaagactcctgctattataagcactcagtccgcttcccacggaactgagcagagaattagtcactgggccaggcgagcccgagcaggtcccgggcgctccagtgtggtggttagtctgccttggtgaagggcagcccactggcatcgtgtcagcacagaaaccttctcaggtacaggctttgttttagattgtaggctctggaacaattcagaagtgtccagcccagccctcctttccctgtgtcggttaccactcaagacgcacatcgtcggggccggccgggtggcgcagcggttaagtgcgcacgttccacttctccacggcccggggttcgccggtttggattccggctgcggacatggcactgcttggcaaaagccatgctgtggtaggcatcccacgtataaagtagaggaagatgggcacagatgttagctcagggccgtcttcctcagcaaaagaggaggactggcagtagttagctcagggctaatcttcgtcaaaaaaaaaaaaaaaa

SEQ ID NO: 115 - DNA, 3244 bp, Homo sapiens
ccacgcgtccgggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaaaacttagttgttagtattaaataagttagattatttgctactgtgagaatattgtcaccactggaagttactttagttcatttaattttaattttatctttagtgaatatttttaagagatagagagctgctttcaatatctagaaatgtttaatgtagtgtaaacatgcctaactttaaaaaaaagagccccttatatgatttccaaaacaacatttagaactgtatacacagaactatagattaatgctctgtttatcaagccagggattgtgggggcccccctcaggctactaaacccacaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattttagggataccaatattagccaaggtattttgaagtgttttcggttttagtttatattacaacactcaaaactcagggtcaagttttgacaaaagatgtatttagtcatactgaatactgagatagtatttctatcttaggtggtcaaagtaaatcacaccaatttctgatagtccaaaaatcagctgagaagtcctaatgaacatgtacctacaattaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcagtacttcaagtcagtcagaactttgtagacaggcctgaaactttcttctatacttgcttctttagcactttgaagatataaaaccactttttaagtactaaatgtcgaaatttgcctttcaagtttcctgtgctttgggtttgaaataatttagttatgtcttttctctgtatgtaaattgtataatttgttattttcaaatacccgtactttgaatgtaggtttttttgttgttgttatctataaaaattgagggaactggtgatgcaaaccaatattctgctttggagcacatttcctaagcataaaaaaaatgctcagttttgcttgcattccttgagaatgtatttatctgaagatcaaaacaaacaatccagatgtataagtactaggcagaagccaattttaaaatttctttggataatccataaaatgaataattcaaatacagataagagtggtagcatattacagtgatcattttgtattttttcacaaaaaaaaagttaaactcttcttttctttttattataaggatcagcttttggtatttcattgttactgagatctatttttagaataaaattgttctccttccaaaaaaaaaaaaaaaaa

SEQ ID NO: 116 - DNA, 627 bp, Homo sapiens
  exon (1)..(627)
atgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaa

SEQ ID NO: 117 - DNA, 4168 bp, Homo sapiens
ggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactgatatccagatttaaagaacgagaagagaacgtaaaggcagatgtttttcatgcatacctttctcttttgaagcaaactcgtcctgtgcaaagttggctgtgtgaccctgatgcaatggaacaaggagaaacacctttaacaatgcttcagagtcaggttcccaacattgttaaagctctgcacaaacagatgaaagaaaaaagtgtgaagactcgacagtgctgttttaacatgttaactgaactggtaaatgtgttacctggggccctaacacaacatgttcctgtgcttgtaccaggaatcattttctcactgaatgataaatcaagctcatcaaatttgaagattgatgctctgtcgtgtctctacgtaatcctctgtaaccactctcctcaagtcttccatcttcatgtccaggctttggtccctccagtggtggcttgtgttggatacccattttacaagattacgtctgaagcacttcttgttactcaacagcttgtgaaagtcattcgtcctttagatcagccttcctcatttgatgccactccttacatcaaagatttgtttacctgtaccattaagaggttaaaagcagctgacattgatcaggaagtcaaggaaagggctatttcctgtatgggacaaattattctgcaccttggagacattttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctaccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgttgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtattgcagaggttggaccgacttgttgagccgttacgcgccacgtgtacaacgaaggtgaaggcaaactcagtaaagcaggagtttgaaaagcaggacgaactgaagcgatcggccatgagagcagtcgcggccctgctgaccattcccgaggccgagaagagcccgctgatgagcgagttccagtcgcagatcagctccaaccctgagctggcagccatctttgagagcatccagaaagactcatcgtccactaacttggaatcaatggacactagttagatgtttgctccatacgggaccattacgttgaccatacgatgcactgaattgacaggttaatcataagacatggaaagagaagtgtctaaaagcttcaaaatgttccacttttttttccttcatggagacagtttggctttcttccattgttgtttttgtagcatttatttcagaaatgtgtatttccataatccagaggttgtaaaaccactaatgtcttagtggttggggcaacatttaaaatggaaactaaaagttaggatttatggagatagggtccagtatctatttgccctgtaatgtttaggattaaaatgttaaaatttaaaaaaaaaaaaaaaa

SEQ ID NO: 118 - DNA, 3693 bp, Homo sapiens
  exon (1)..(3693)
atggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactgatatccagatttaaagaacgagaagagaacgtaaaggcagatgtttttcatgcatacctttctcttttgaagcaaactcgtcctgtgcaaagttggctgtgtgaccctgatgcaatggaacaaggagaaacacctttaacaatgcttcagagtcaggttcccaacattgttaaagctctgcacaaacagatgaaagaaaaaagtgtgaagactcgacagtgctgttttaacatgttaactgaactggtaaatgtgttacctggggccctaacacaacatgttcctgtgcttgtaccaggaatcattttctcactgaatgataaatcaagctcatcaaatttgaagattgatgctctgtcgtgtctctacgtaatcctctgtaaccactctcctcaagtcttccatcttcatgtccaggctttggtccctccagtggtggcttgtgttggatacccattttacaagattacgtctgaagcacttcttgttactcaacagcttgtgaaagtcattcgtcctttagatcagccttcctcatttgatgccactccttacatcaaagatttgtttacctgtaccattaagaggttaaaagcagctgacattgatcaggaagtcaaggaaagggctatttcctgtatgggacaaattattctgcaccttggagacattttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctaccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgttgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtattgcagaggttggaccgacttgttgagccgttacgcgccacgtgtacaacgaaggtgaaggcaaactcagtaaagcaggagtttgaaaagcaggacgaactgaagcgatcggccatgagagcagtcgcggccctgctgaccattcccgaggccgagaagagcccgctgatgagcgagttccagtcgcagatcagctccaaccctgagctggcagccatctttgagagcatccagaaagactcatcgtccactaacttggaatcaatggacactagttag

SEQ ID NO: 119 - DNA, 3683 bp, Homo sapiens
gcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttctggcaaagactttgtacatttgggaatttttataagaaacttaatgttattatctgggggcacattggcccctgtgctttctcctttaattgtaatgtaaaagctataaagcggtatttttcttgacaaatggcatatgttttccatttctatgcatgcatttaaatcagtttatacaaaaaacttattttattttttagttttaactgtgtttctccgacagctcacctctctctgaccacccagccatttccttcctgtgctccacgttcttctgtatgatgaaaataagaatactatttttggaaatatgcgactccttttcagagaccaggagggatttatgtagcagctatttttactgcaaaagtaattcactggaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacacgagacgatttccagtatctcagcacaggatgtttttctcaagcaggccctgtttatctctcggacatctgtttataacatcaacagacatgcgactgggaacatcttgttgctgaaagaagtcatgaaccattggctcattttatatgggctcgagccacatgaaattgccaatatttgacttttttatctacgaagttggcagttttgtgtggtccaacctaatagttatggaatctgaagtccagtataaacctctggcgtggtaatgaacaggacttaagtataaaaattttgtaattgggcctcttctttctcaaataataaagtattttgtttatataaaaaaaaaaaaaaa

SEQ ID NO: 120 - DNA, 1410 bp, Homo sapiens
  exon (1)..(1410)
atgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactga

SEQ ID NO: 121 - DNA, 905 bp, Equus caballus
  Oligonucleotide Sequence
ccttatttaaccagtcaagtaaccaaccaaagtgttaagtttaggcatttaggaaaagctgtaaactctcacattgctgaaattccccctcattgtgtcccctggccaggtgcctcccgagggttggtcttgttccattttgttctggtcaccggatgatttcttccttcgccatcaaatacttcttcgtaatggtcaccatctgagggtttgtcccatttctggattcttcccaagctctaacccaacactcctcctatttaaaacatcccaccgtggtcagacctctgtggtgaagctgactctcacccctcactgttctgtctacagagctgctcgctagagtggcctgccctgctgctcgagcgcgagggcggggcaccgtggaagaactctgactgcttgcagactgtctctgcttgggttcttattgctttctgcttttcgaaattatgccagcctctgcctgggtctgggtctagattaggatttaagctggtaaaggaaaatgttggtaaatcctctgctcagaagtcatttatcatgtttctatttaaggattaaagttattaacttaccctatttagaagctgacccatttaaatataactcttcgaagttctacttctcttttattcttgatgtcttaagatgattctaactggcatctggggcttggggtctccctgtccttccattatcttttgtttttcccaagaaattctgaacacatacctctttgctaaaccaggatcctctgttttgactctgttttcgtaccaggtaagaggacttctttcaaagagctttttactgcttgaccaaagaacaaatctgaaaatcaccaagttaacgttgttactttttctgttgaccaaagcttaagtgaggagaatttttggctt

SEQ ID NO: 122 - DNA, 702 bp, Equus caballus
  Oligonucleotide Sequence
actctcagcatctgagagccttaagcccccgaaatattccaaggttttattgtacttttttaaagaacagaaaagggtgaataaaagaaccaagtagaaatgcagggactatatttagcatgtacaagttgaagtaaaaaagagattgtggcaactaagtaactagtcctgtaaaataaaatacattgctcacctttcctgtacatctagttcctcaccatagaacccacctgggcaaaccccaactctagaactctcagacgctgcgacagcgtccgaacaggcaaagagctagatttcaaaggctcgcttcgcaaaaatactccatcttggcaccttgctcttttagaaaggccttaatgattgaaaaaaattacttggcccctgagagtataattttcagcccctgaagcttgctaatataaagaacaacttttaattatgagaaataaaaactgagatgctgtaaaatcctgtcagaccaccgatagactgatcggaaagacagtgtcagctcagaaggggtcagcggacactgtacggagcgtgggtgtttggattctcagggaaactccgactggatttatttttctacctgtgtatgtcttatatagtgctggtgctctatagttttgttctctatttaatctgtatgtattaacgataacacgtttgatagttgtcacataaaaaaaaaaaaaa

SEQ ID NO: 123 - DNA, 851 bp, Equus caballus
  Oligonucleotide Sequence
tgcatcctgtcaggatagaatcctatcagacaaccaatttggatttgtcctcttatggagaacgttcatttccgtcccttgattaagatggtgtgtgctatgcttctccatcgcaaagtcactcttttatcctttgaaattaacaaatatttgtttggggatgtgcttgagatgatgtaaatgtcctattcctcattaaatctctaatttatccatttattcctgatatagacttagtgattcttattttattcggtgggctgtaatctgttatcattatcatctcatttatctattctcatgtgcccatttttcttgatttggccaataggacaccttcaagctgacttccgtgtcttttttgacttgtccctacttccttactttctgacagcaatatgattttcctggctcatctcattctttcccttccccagcccaggaatctaccatttctctaaggagccttgctttcttttagtggagaatagtattaagaaaaccaagatctgggtactaaatgatctcattgctattggagtcttgctactcctagatcctttccatggacagaggttgggaatgtgtacacacacacatacacatatgcacacatacacatgcaaacataatttgttcatgttcaacatctatatttctatatttatctatattaaaaatcatgatgacacactcacatctctgatttcagtccaacactacagggttcattctggttctccactttcatatttgtaatttccttccccaccagtgagaaaccgggcttccattatcctccacatatatccttatttggccagttcttctgtatgtatccagtatcccat

SEQ ID NO: 124 - DNA, 494 bp, Equus caballus
  Oligonucleotide Sequence
tggtagaaatgagtcaaagttctgagtgttaggatagttgagatgaactggagctacttcacaattttgcctgcactcttcattcttacctgcaccctaaccccttgcaccatgactgatgtgtggcaaatactcaatgttagtgaatagaacacgttagttcttgtgttattgcattagctcccttcgatgggcatctctatgaattagatggatggaaactatttccaattaactttattagaggatgccacagaggtttgcaagaaacttatggaatgtgaccctgatgaattaggattcattgtgatcactctttctgacgcatagcttgtcaataatggaagcaccaaatactgtcttatttgcaacagaaattaaatttttgctgccatacactaactcaaaaattttgatattttcattaacttgacttgataaactttatgtgaattaaaccttgtgaattaaaccttgtctttaaaaaaaaaaaa

SEQ ID NO: 125 - DNA, 729 bp, Equus caballus
  Oligonucleotide Sequence
actcatttatatcttgtagtttactattttacctctagaaatagacttaaaagtagtttgtgtgtgaatatttaactacacgaaagttagcaaaattaacatttggaaaccttctattccatatgttagcatttattccaacatctttttagccttatttagtctaatttaaaattttcaagcaaccctatcttatcatcttcacatggtgtttacaattttgcaacgtggattattctctgtataatatgtgaaattcattgcttgatacttttgacccaaaattatgtttgttacagttgaacttaaataaagatctttaaacaaaaaaaaaaaaaaaaaacgcgagactagttctctcgtgacacccactcttccaccttcgatgctggggctggcattgccctcaacgaccactttgtcaagctcatttcctggtatgacaatgaatttggctacagcaatagggtggtggaccttatggcccacatggcctccaaggagtaagagccccctggaccaccaatcacccagcaagagaaggagaaaggccctcagctgctgggaatgcttgtcccaacttgaccccctaacatattgagagtctcctgacctccacagtttccatctcagacccccctgaagaaggggaggggcttggggagccctaccttgtcatgtaccatcaataaagtacactgtacccaaaaaaaaaaaaaaaaaaaaaaa

SEQ ID NO: 126 - DNA, 2223 bp, Homo sapiens
gctcgccagggaagggccctacccagaggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcaacgattctttgggttgaatgtgacagggaagccaaatgaggaaactctggaaatgatgcagaaacctcgctgtggagtgcctgacactggagagtttatgataaccccagggaaccccaagtgggaacgaaataacctgacctacaggattattaactataccccacagctgtcagaggctgaggtagaaagagctatcaaggatgcctttgaactctggagtgttgcatcacctctcatcttcaccaggatctcacagggagaagcagacatcaggattgctttttaccaaggagatcatggtgacaattctccatttgatggacccaatggaatccttgctcatgcctttcagccaggcccaggtattggaggagatgctcattttgatgcagaagaaacatggaccgacaacagaacaaattacaacttgcttattgttgctgcccatgaatttggccattccttggggctcgctcactccacaaaccctgctgccttgatgtatcccacctacgctttcagggaccccagcacctacttgctctctcaggatgacatcaatggcattcaggccatctatggaccttcaaatgaccctatccaaccaactggatcaaccgcgcccaccgcctgtgaccccagactgacatttgatgctatcgtcacactccgcggagaaacgcttttctttaaagacaggtacttttggagaaggcatccccaactgccaacagtcgaactcaatttcatttctctgttctggccatccttgccaaatggtatacaggcggcttatgaggattttgacagggacctaattttcctatttaaaggcaaccaatactgggctctgaatggctatgacattcagcaaggttatcccaaggacatatcaaactacggcttcccaagcagtgtccaagcaattgatgcagctgtttcctataggagtaaaacatacttctttgtaaatgatcaattctggagatatgataaccaaagacgatccatggaagcaggttatccccaaagcatagcaagtacctttccaggaataggaagcagaattgatgcagttttccagcaagatgacttctttcttttcttcagcggaccagtttattatgcatttgatcttaatactcagagagttactagggttgcaagaatcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagagcatagccacctaggggaggaggccgtgtgaagacagaggcagagattggagtgacgcatctccaagccaa

SEQ ID NO: 127 - DNA, 1404 bp, Homo sapiens
  exon (1)..(1404)
atgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcaacgattctttgggttgaatgtgacagggaagccaaatgaggaaactctggaaatgatgcagaaacctcgctgtggagtgcctgacactggagagtttatgataaccccagggaaccccaagtgggaacgaaataacctgacctacaggattattaactataccccacagctgtcagaggctgaggtagaaagagctatcaaggatgcctttgaactctggagtgttgcatcacctctcatcttcaccaggatctcacagggagaagcagacatcaggattgctttttaccaaggagatcatggtgacaattctccatttgatggacccaatggaatccttgctcatgcctttcagccaggcccaggtattggaggagatgctcattttgatgcagaagaaacatggaccgacaacagaacaaattacaacttgcttattgttgctgcccatgaatttggccattccttggggctcgctcactccacaaaccctgctgccttgatgtatcccacctacgctttcagggaccccagcacctacttgctctctcaggatgacatcaatggcattcaggccatctatggaccttcaaatgaccctatccaaccaactggatcaaccgcgcccaccgcctgtgaccccagactgacatttgatgctatcgtcacactccgcggagaaacgcttttctttaaagacaggtacttttggagaaggcatccccaactgccaacagtcgaactcaatttcatttctctgttctggccatccttgccaaatggtatacaggcggcttatgaggattttgacagggacctaattttcctatttaaaggcaaccaatactgggctctgaatggctatgacattcagcaaggttatcccaaggacatatcaaactacggcttcccaagcagtgtccaagcaattgatgcagctgtttcctataggagtaaaacatacttctttgtaaatgatcaattctggagatatgataaccaaagacgatccatggaagcaggttatccccaaagcatagcaagtacctttccaggaataggaagcagaattgatgcagttttccagcaagatgacttctttcttttcttcagcggaccagtttattatgcatttgatcttaatactcagagagttactagggttgcaagaatcaataaatggcttaactgtagatatggctga

SEQ ID NO: 128 - DNA, 704 bp, Homo sapiens
gcgccgagcgatgggcatctctcgggacaactggcacaagcgccgcaagaccgggggcaagagaaagccctaccacaagaagcggaagtatgagctgggccggcccgcggccaacacgaagattggcccccgccgcatacacacagtccgcgtgcggggaggcaacaagaagtaccgggccttgaggttggacgtggggaacttctcctggggctccgagtgctgtacgcgcaaaacaaggattattgatgttgtctacaatgcatccaacaacgaattggtccgcaccaagaccctggtgaagaactgcatcgtgctggttgacagcacaccgtaccgacagtggtacgagtcccactacgcactgcccctgggccgcaagaagggggccaagctgactcctgaggaggaagaaattttaaacaaaaaacgatctaaaaaaattcagaagaaatatgatgaaaggaaaaagaatgccaaaatcagcagtctcctggaggagcagttccagcagggcaagcttctcgcatgtatcgcttccagaccaggccagtgtggccgagcagacggctatgtgctcgagggcaaggagctggagttctatctgaggaaaatcaaggcccggaaaggcaaataaatccttgttttgtcttcacccatgtaataaaggtgtttattgttttgttcccaaaaaaaaaaaaaaa

SEQ ID NO: 129 - DNA, 627 bp, Homo sapiens
  exon (1)..(627)
atgggcatctctcgggacaactggcacaagcgccgcaagaccgggggcaagagaaagccctaccacaagaagcggaagtatgagctgggccggcccgcggccaacacgaagattggcccccgccgcatacacacagtccgcgtgcggggaggcaacaagaagtaccgggccttgaggttggacgtggggaacttctcctggggctccgagtgctgtacgcgcaaaacaaggattattgatgttgtctacaatgcatccaacaacgaattggtccgcaccaagaccctggtgaagaactgcatcgtgctggttgacagcacaccgtaccgacagtggtacgagtcccactacgcactgcccctgggccgcaagaagggggccaagctgactcctgaggaggaagaaattttaaacaaaaaacgatctaaaaaaattcagaagaaatatgatgaaaggaaaaagaatgccaaaatcagcagtctcctggaggagcagttccagcagggcaagcttctcgcatgtatcgcttccagaccaggccagtgtggccgagcagacggctatgtgctcgagggcaaggagctggagttctatctgaggaaaatcaaggcccggaaaggcaaataa

SEQ ID NO: 130 - DNA, 2726 bp, Homo sapiens
ggggaccggcctgggcccttgagcctggctggagtaggtggaatatcctggggagaggaagtttggtcgttgggcagcggccgactttcctctcaggaaattgatactttatcaacatagagattaattatttgtatttgggagcagcagaactggggaccaattacctgtcaagagttttataaacccgtgacataaactgttattccattgctttcatcctccatctcaccttggaacttgtattacttatggcgttcaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaaggttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaagaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcacccctttgctcctggaggcccagtgtcttctgatgaagaggaaaatgacaacctcaatctactggaaattcttccagataactctgattctgctcaaaagaaaagtcacatttccagcagtaactgggtagagttttccacccaaactgtagaccccttcacctctatgtcctgttctggttttcagacaagcaaaggcctgcctagggagcctgaagtgaagaattccattaagggtcttctaggggaggtaaagaatgcgatagtcaaattacacgaagatctgagcatggtgatccaggagctgaacgtcatcaataacatcttgatgagcatgagtctgaatagttcacaaataagccagtcttcccaggtcccccagtcttctgaggggggctcagatccagtctaatcatcacaatatctatttttgatagaactcgtgtggttccacttccccaagacttacgttagcattgtataaattcatattattatggcaaaaaaggggatggtttgatttctctttgtcaggtttgttaacaagtatctttcaaaccagtaaattcattcaggtggtttattttttaaagagaaaaagtatcccctttgataatatcatcagatttagatattagttcatttgaaactgaaaagaattttattctttcatgctctgtacctcaaatgggttaagcattagtgaaatttgtggtaagacctcaaactgcaagtgactattgcagagcctttggataagggaggcaggaagaagctctttatctttcaactgtatggagcttgttaacaagcctctgaggtgacctaggaggattgagtttgggggtatacatttcacacattcttttgcaagttttaggttctgcaaccaagggccagaaatcttttctttcttccagatgctagtgttaggagttaaatggaaacaagaaggacatggggcaaatgtttttactgtcaatgtatattgcaaagtgaattcaaatgcatccttttattctacttcagaaaataaatttgatatttttcaaaaaaaaaaaaaaaa

SEQ ID NO: 131 - DNA, 1821 bp, Homo sapiens
  exon (1)..(1821)
atggcgttcaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaaggttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaagaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcacccctttgctcctggaggcccagtgtcttctgatgaagaggaaaatgacaacctcaatctactggaaattcttccagataactctgattctgctcaaaagaaaagtcacatttccagcagtaactgggtagagttttccacccaaactgtagaccccttcacctctatgtcctgttctggttttcagacaagcaaaggcctgcctagggagcctgaagtgaagaattccattaagggtcttctaggggaggtaaagaatgcgatagtcaaattacacgaagatctgagcatggtgatccaggagctgaacgtcatcaataacatcttgatgagcatgagtctgaatagttcacaaataagccagtcttcccaggtcccccagtcttctgaggggggctcagatccagtctaa

SEQ ID NO: 132 - DNA, 2140 bp, Homo sapiens
aagaaacgcagctcttgactgcttttttgtaaacattactgtattattgtgataactttttattctactatgtatatgtatggaatagtattaataaatgaactagggaaggatgtaataaattagacgtctcttcattttagagaaagaagatggaaacatcattggttttcttttctcaattaaatatgtgcgaatcaaaagaaaaaacttttttcaagttaatacatggttcaggaaaagaagaaacaagcaaagaagccaaactcagagctaaggaaaaaagaaacaggttaagtctgctcttgcagaaacctgaatttcatgaagagacccactccggtagatccgggcacttagccaaagaaacgagaatctcccctgcagaagccgtgatatggggtgaatcatttgacaaactgctctcccataaaggtggactggagacttttaccagatttcttaaaaccgaattcagtgaggaaaacattgaattttgggtagcctgtgaagatttcaagaaaagcaaagaccctcaacaaattatccttaaagcaaaagcaatatatgagaaatttatacagaacgatgctccgcaagaggttaaccttgatttccacaccaaagaaatcattgccaagagcatcaccaaacccactctccacagttttgatgctgcacaaagcagagtatatcagcttatggaacaagacagttacacacgttttctgaaatctgacatctatttagacttgacagaaggaagacctcagaggccaacaaatcttaaaagacggtcacgttcatttacctacaatgaattccaggatgtaaagtcagatgttgccatttggttataaagaaaattaattttgctcgtttttatgacaaacttatacatctgcttctaacatatcgcatgtttatgttaagatttggtcccatcctttaaactgaaatatgtcatgtgaaattattttaaaaatgtaaaaacaaaactttctgctaacaaaatacatacagtatctgccagtatattctgtaaaaccttctatttgatgtcattccatttataatcagaaaaaaaacttatttcttaatcaaaaggcagtacaaaaaaagtaataatgttttataagattgtagagttaagtaaaagttaagcttttgcaaagttgtcaaaagttcaaacaaaagtctagttgggattttttaccaaagcagcataatatgtgttatataaacataataatactcagatatccaaatgttcagatagcatttttcataatgaatgttctcttttttttggtaatagtgtagaagtgatctggttcttacaatgggagatgaagaacatttattattgggttactactaaccctgtcccaagaatagtaatatcacctctagttataagccagcaacaggaacttttgtgaagacacattcatctctacagaacttcagattaaatataatctagattaatgactgagaataagatccacatttgaactcattcctaagtgaacatggacgtacccagttatacaaagtacttctgttggtcacagaaacatgaccagattttgcatatctccaggtagggaactaagtagactaccttatcaccggctaagaaaacttgctactaaactattaggccatcaatggcttgaataaaaaccagagaaggtttttcccaggacgtctcatgtttggccctttagaattggggtagaaatcagaaatgagatgaggggaagaagcaaggagtctaaggccctagcgatttgggcatctgccacattggttcatattcagaaagtgttatctcattgattatattcttgttaagcaaatctccttaagtaattattattcaaataagattatactcatacatctatatgtcactgttttaaagagatatttaatttttaatgtgtgttacatggtctgtaaatatttgtatttaaaaatgccatgcattaggctttggaaatttaatgttagttgaaatgtaaaatgtgaaaactttagatcatttgtagtaataaatatttttaacttcattcatacagttaagtttatctgacaataaaagctctgactgaaaaaaaaaaaaaaaaaaaaa

SEQ ID NO: 133 - DNA, 708 bp, Homo sapiens
  exon (1)..(708)
atggaaacatcattggttttcttttctcaattaaatatgtgcgaatcaaaagaaaaaacttttttcaagttaatacatggttcaggaaaagaagaaacaagcaaagaagccaaactcagagctaaggaaaaaagaaacaggttaagtctgctcttgcagaaacctgaatttcatgaagagacccactccggtagatccgggcacttagccaaagaaacgagaatctcccctgcagaagccgtgatatggggtgaatcatttgacaaactgctctcccataaaggtggactggagacttttaccagatttcttaaaaccgaattcagtgaggaaaacattgaattttgggtagcctgtgaagatttcaagaaaagcaaagaccctcaacaaattatccttaaagcaaaagcaatatatgagaaatttatacagaacgatgctccgcaagaggttaaccttgatttccacaccaaagaaatcattgccaagagcatcaccaaacccactctccacagttttgatgctgcacaaagcagagtatatcagcttatggaacaagacagttacacacgttttctgaaatctgacatctatttagacttgacagaaggaagacctcagaggccaacaaatcttaaaagacggtcacgttcatttacctacaatgaattccaggatgtaaagtcagatgttgccatttggttataa

SEQ ID NO: 134 - DNA, 10819 bp, Homo sapiens
tgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgtgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagatcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccgagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcacgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatc

SEQ ID NO: 135 - DNA, 7884 bp, Homo sapiens
  exon (1)..(7884)
gcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgtgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagatcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccgagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcacgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataa

SEQ ID NO: 136 - DNA, 1164 bp, Equus caballus
  Oligonucleotide Sequence
gaaggtttccctgagcgtctctaagctcgcccagccagacaccctgtgcccctccatttgtgtcctctgtccccctttcctgcttccctccttccccaccgtggctggtctaggtgtctgtaatagtcagaatgcaggtttggcaacttgaacaaaacttttaaataacagtggcttaaaccacaaaaaaaaattgatttctctggtaatatctaagcacaagcaggccaggcaatatggggactccctggttttgagatccaggattcccaggtcttggcgctacgaggtccacattctaggcctcaagaccagggaagaaggcagtgaaagggagcatgaccctccccttcaagggcacagctaggaatcacccacatcacctctaattggctggaatgtggtcacacggtcacacctagctgcaaggaaggcagggaaatgtagtctttattctgaccacaacgtgcccaggtgaaatttgtcactagagaaccggtgggcagatatgtgtagataatcaataatctccacctcaggggcattgaggcagcctcttacttcctctgcgtgacaccagagttcgattcccatctgaaacgacccctctttgtaccaccagctccactagggctgcgtaagggagggtggtagttctcaagaaggggagattttgcccccacaggggacatttggcaaagtccagagacattttccgttgtcacaacttggggggtgctatcgccatctagtggggagaggtcaccgatgctgctaaacatcatatgatgcccccaccaacatagagttgtctggcccaaagcatcagcagaagccctgatgcagggaaagcgtgcgttccccggggtcagacacgcctgacttctaaccctgaagccccgcctccctccccgtgtggccttagtgaccaatcagtcacttcacccctcggaacatcgatgatggtaacatggacttccctgcattgtatgagaaccaattcaggtcgtttactgagggcttaccatgtgctgtgtgctctgtgtaccctcagatcacgtgaactccctttccatgcgcacatttactagcacctactatgcggggaagtggattcctctggatgattttgttataataaacagaaaaacagcttgaaaaaaa

SEQ ID NO: 137 - DNA, 14804 bp, Homo sapiens
tcttggagcgttctcagtttctcaacagatcttcacttgctaggcagccagaagccggcggcagtggcggcaccgcctcctcctcacattcccggggtggcggggttagatgagcggccccagtcgcggcgccgggggcgctgttcatgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtcgtatctcattattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttatgtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaagaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaaggaaggaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctgtacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaacgtgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaagttgatctggattccaggcacattggctgggtaacaagtgaacttccaggaggagataatcacatcatcaaaattgaattaaaaggcccagaaaatacactgagagttcgacaagttaaggttctgggctggaaggatggtgaaagcactaaaattgctggccagatttcagccagtgtggcccagcaaaggaactgtgaagctgagactctgcgagtgttcagacttattacatctcaagtatttggaaagctcatctctggagatgctgaacccacaccagaacaagaggaaaaagcactgttgtcatcacctgaaggagaggaaaaagtatacaatgcaacatcagatgctgacctgaaagaacatatggttggaatcatattcagcaggagtaaactgactaacttacaaaaacaggtgtgtgctcacatagtccaggctattcgcatggaagctaccagagttcgtgaagaatgggaacatgccatatcaagcaaagaaaatgccaattctcagcccaatgatgaagatgcctcctctgatgcttactgctttgagctgctctcgatggttttagcactgagtggctctaacgtgggccggcagtatctggctcagcaactaactctgctccaggatctcttttcactgctccacacagcctcccctcgagtccagagacaggtgacctccttactaagacgagttttacctgaagtgacccctaatcggctggccagcatcataggagtgaaatcccttcccccaccagatatcagtgatatcattcactcaacagagaaaggagattggaataagctaggtatcttggacatgtttctaggatgcattgccaaagcactcacagtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccattttgacatccatgaaaatgaaccattcacagtgcaagaaggatgccaaataccatgtacataattcttgctatggaaagtttccccattatttcggtttatcttcttttgaaccaagacatcaaacttgtgaggtgtttgcatgtggccattaccgtcattggcctgtgaagcattggacatttatagataattgatataaaagaattgccatacctatggactaagaatgatgctggctttcaagcaaaaaagaaaaataatcattgtttattgtatactacctttttgtaatcctgtacaattgcatcacgggtggggataaaaaaaggaatattctggtttatttcctagactgttatttaaaaaaaaaaaaaacattgtgttaggacggcatataaatgtaataagtatcacactgtatataaagatatcaatgtttgtcctgtataagaattactaaattacaaatgcagtttcatttaaacttctaggttaagtttgagcctgaaattttaatgaagtgcaatactgagtgtgcctcattatcttgcagctgtaaacatattggaatgacatgtcaataaaccactgtacatttttatacagtgataaagtctaaaaaaaaaaaaaaa

SEQ ID NO: 138 - DNA, 6540 bp, Homo sapiens
  exon (1)..(6540)
atgccggttcccgacggctccgtggctgctgcggggctggggctggggctacccgccgcggactccccgggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaagtgctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtcgtatctcattattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaattaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacacgtaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaccacttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttatgtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcacca

SEQ ID NO: 139 - DNA, 1923 bp, Equus caballus
agggaagtagggagctatcagactgctttatcggagaaggaagacagaggccagcatgctcagccttcctctgctgctgctgctactctggggcatgggctctcacagcttcccaacagtgccttcagaaacacgagaagaagatgtggagatggtccagaaatacctggaaaactactacaacctgaagagtgatggagagcaaattgaaaagcagagacacaggagcccagtcgttgaaaagctgaagcaaatgcaggaattctttgggctgaaagtgactgggaagccagatgctgaaaccctgaatgtgatgaagcagcccagatgcggggtgcctgatgtggctgagtttgtcctcaccgaagggaaccctcggtgggagaacacacacctgacctacaggattgaaaattacacaccagatttaccaagagcagatgtggaccaggccattgagaaagcctttcaactctggagtaatgtctcacccctgaccttcactaaagtctctgagggtcaagcggacataatgatatcctttgtcaggggagatcatcgtgacaattctccctttgatggacctggaggaaacctcgcccatgcttttcagccaggcccacgtattggaggggatgctcattttgatgaagatgaaacatggaccagcaatttcagaaattacaacttgtatcgagttgcagctcatgaatttggccattcccttggactctctcattctactgatattggggctttgatgtaccccaactacttcttcactggtgatgttcagctatctcaggatgacatcaatggcatccaggccatctatggaccttcccaaaatcccatccagccaattggcccacaaaccccagaagtgtgtgatagtaagctaacctttgatgctataactacgattcggggagaagtgatgttctttaaagacaggttctacatgcgcataaatccttactacccagaagctgagctcaatttcatttctattttctggccacaactgccaaatggacttcaagctgcttatgaggtttcccatagagatgaagtccggtttttcaaaggtaataagtactgggctgttaaggggcaggatgtgctctacggataccccaaggacatccacagatccttcggctttcctagcactgtgaagaatatcgatgctgctgtttctgaggaagatactgggaaaacgtacttctttgttgctgacaagtactggaggtacgatgaatataaacgatctatggatgcaggttatcccaaaatgatagcagatgactttcctggaattggcgacaaagttgatgctgtttttcagaaagatggatttttctatttctttcacggaacaaggcaatacaaatttgatcctaaaactaagagaattttgactctccagaaagccaatagctggttcaactgcagaaaaaattgaccattacaaagttgaacagaaaaatatattttgagaacccaaggaagatgttttcctgaagagccatacatttaaataaaatacagagctgttacgtataatcttatttatatctcattctgcaaatattttttacaatttagaatgcaatgtttcatgtactgctataatttacttccaccaatgagggtgaaggaaggtcaagttctgatttacggattcatatgggccaattttgcaaagagagaagctcttttccaaagtagaagactctgacattgatactggagagcagcctcagagatggagagaaagaaacaagagatacgagtcttcaccagaggaaaagcagctcaagaacatctgagctgctactagtattatcctaatatgcaagggataatttttgttacggaaaataaaatcttttatgtttggaataaaaaaaaaaaaaaaaa

SEQ ID NO: 140 - DNA, 1410 bp, Equus caballus
  exon (1)..(1410)
atgctcagccttcctctgctgctgctgctactctggggcatgggctctcacagcttcccaacagtgccttcagaaacacgagaagaagatgtggagatggtccagaaatacctggaaaactactacaacctgaagagtgatggagagcaaattgaaaagcagagacacaggagcccagtcgttgaaaagctgaagcaaatgcaggaattctttgggctgaaagtgactgggaagccagatgctgaaaccctgaatgtgatgaagcagcccagatgcggggtgcctgatgtggctgagtttgtcctcaccgaagggaaccctcggtgggagaacacacacctgacctacaggattgaaaattacacaccagatttaccaagagcagatgtggaccaggccattgagaaagcctttcaactctggagtaatgtctcacccctgaccttcactaaagtctctgagggtcaagcggacataatgatatcctttgtcaggggagatcatcgtgacaattctccctttgatggacctggaggaaacctcgcccatgcttttcagccaggcccacgtattggaggggatgctcattttgatgaagatgaaacatggaccagcaatttcagaaattacaacttgtatcgagttgcagctcatgaatttggccattcccttggactctctcattctactgatattggggctttgatgtaccccaactacttcttcactggtgatgttcagctatctcaggatgacatcaatggcatccaggccatctatggaccttcccaaaatcccatccagccaattggcccacaaaccccagaagtgtgtgatagtaagctaacctttgatgctataactacgattcggggagaagtgatgttctttaaagacaggttctacatgcgcataaatccttactacccagaagctgagctcaatttcatttctattttctggccacaactgccaaatggacttcaagctgcttatgaggtttcccatagagatgaagtccggtttttcaaaggtaataagtactgggctgttaaggggcaggatgtgctctacggataccccaaggacatccacagatccttcggctttcctagcactgtgaagaatatcgatgctgctgtttctgaggaagatactgggaaaacgtacttctttgttgctgacaagtactggaggtacgatgaatataaacgatctatggatgcaggttatcccaaaatgatagcagatgactttcctggaattggcgacaaagttgatgctgtttttcagaaagatggatttttctatttctttcacggaacaaggcaatacaaatttgatcctaaaactaagagaattttgactctccagaaagccaatagctggttcaactgcagaaaaaattga

SEQ ID NO: 141 - DNA, 2716 bp, Homo sapiens
atggcggaggagccggggaggcgggaggcgggaggcgggaggtgttggggccgttgaagcggcctccctcccgcccccagccgcccggtctggccccagccctgtcccgacccccggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggacagtggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcatttgcatcttctcatatattgtgttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggagtgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtccaaaccactaatatgtatgtaaaaattgtgctgtatactacaataaagttgttacttggatttgttccaaaaaaaaaaaaaaa

SEQ ID NO: 142 - DNA, 717 bp, Homo sapiens
  exon (1)..(717)
atgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggacagtggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatga

SEQ ID NO: 143 - DNA, 1425 bp, Homo sapiens
cttttcctgtggcagcagccgggctgagaggagcgtggccttctcctctccctgccatggcgtgtgctcgtccactgatatcagtgtactccgaaaagggggagtcctctggcaaaaatgtcactttgcctgctgtgttcaaggctcccattcggccagatattgtcaactttgttcacaccaacttgcgcaaaaacaacagacagccttatgccgtcagcgaattagcaggtcatcaaaccagtgctgagtcttggggtactggcagagctgtggctcggattcccagagttcgaggcggtggtactcaccgttctggccagggtgcttttggaaacatgtgtcgtgggggccgcatgtttgcaccaaccaaaacctggcgccgttggcaccgcagagtgaacacaacacagaagcgatatgccatctgctctgccctggctgcctcagccttaccagcgttggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcacgtgggacgtttttgcatttggactgaaagcgctttccgcaagttagatgatctttatggcacttggcgtaaagctgcttccctcaagagtaactacaaccttcccatgcacaagatgctcaatacagaccttagccgaatattgaagagcccagagatccaaagagccctccgagcaccacgcaagaagattcatcgcagggtcctgaagaagaatccactgaaaaacctgagaatcatgttgaagctaaacccgtatgcgaagaccatgcgcaggaacaccattcttcgccaggccaagaatcacaaactccgggtggataaggcagcagcagcactagaagccaaatcagatgagaagggggttccaggcaagaagcctgtggtagggaagaaagcaaagaaggctgttgacgttaagaagcagaagaagcctttggtgggaaaaaaggctgcagctactaagaagccagcagctgagaagaagcctgcagaaaagaaacccgctgcagaagaaaagaagcctgctgcgtaaacttgtttgtttatttcataaaggtcacatcattttggacagctccttttgaataaagacctgattatacaggcagtgagaaacaaaaaaaaaaaaaaaa

SEQ ID NO: 144 - DNA, 1269 bp, Homo sapiens
  exon (1)..(1269)
atggcgtgtgctcgtccactgatatcagtgtactccgaaaagggggagtcctctggcaaaaatgtcactttgcctgctgtgttcaaggctcccattcggccagatattgtcaactttgttcacaccaacttgcgcaaaaacaacagacagccttatgccgtcagcgaattagcaggtcatcaaaccagtgctgagtcttggggtactggcagagctgtggctcggattcccagagttcgaggcggtggtactcaccgttctggccagggtgcttttggaaacatgtgtcgtgggggccgcatgtttgcaccaaccaaaacctggcgccgttggcaccgcagagtgaacacaacacagaagcgatatgccatctgctctgccctggctgcctcagccttaccagcgttggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcacgtgggacgtttttgcatttggactgaaagcgctttccgcaagttagatgatctttatggcacttggcgtaaagctgcttccctcaagagtaactacaaccttcccatgcacaagatgctcaatacagaccttagccgaatattgaagagcccagagatccaaagagccctccgagcaccacgcaagaagattcatcgcagggtcctgaagaagaatccactgaaaaacctgagaatcatgttgaagctaaacccgtatgcgaagaccatgcgcaggaacaccattcttcgccaggccaagaatcacaaactccgggtggataaggcagcagcagcactagaagccaaatcagatgagaagggggttccaggcaagaagcctgtggtagggaagaaagcaaagaaggctgttgacgttaagaagcagaagaagcctttggtgggaaaaaaggctgcagctactaagaagccagcagctgagaagaagcctgcagaaaagaaacccgctgcagaagaaaagaagcctgctgcgtaa

SEQ ID NO: 145 - DNA, 2197 bp, Homo sapiens
  misc_feature (2028)..(2028): n is a, c, g, t or u
ggcacgaggcgggggcggtgcatgacgcgcctcgggggcggtcctcgggcgcgcaccgctctcttacactcgggtctcggaagtccgtgccagcgaccgaggcgacggcgagcggatcccagcggcctagaaaaatcctgcaaaaatgtctctgtacccatctcttgaagacctgaaggtagacaaagtaattcaggctcagactgcctattctgcaaaccctgccaacccagcagttttgtctgaagcttctgctcctcccgtctctcaagatggaaatctctatcctaagttgtatccggagctctctcagtacatgggcctgagtttaaacgatgaagaaatacgtgcaaatatggccatgatccctggagcaccaattcaggggcaattggtagcaagaccttccagtatgaactatatggtggctcctgtaaccggcaatgatgttgggattcgtagagccgaaattaagcaagggattcgtgaagtcattctgtgtaaggatcaagatggaaaaattgggctccggcttaaatcaatagataacggagtatttgtgcagctagtccaggcaaattctccagcctcgctggttggcctgaggtttggggaccaagtactccagatcaacggggaaaactgtgcaggctggagctctgataaatcgcacaaggtgctcaaacaggcttttggagagaagattactatgactattcgtgacaggcccttcgaacggacaattaccatgcataaggatagtactggacatgttggttttatctttaaaaatggaaaaataacatccatagtgaaagatagttctgcagccagaaatggtctcctcacaaaacataacatctgccgagatcaatggatagaatgtcattgggctgaaggactctcaaattgcagacatactgtcaacatctgggactgtagttactattacaatctgccctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctggggatcttactctttcatctgataccttgttcagatttcaaaatagttgtagccttatcctggttttacagatgtgaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgtcatattactttagttctatagcatacttgcatctttaacatgctatcatagtacatttagaatgattgcctttgatttttttttttaaattctgtgtgtgtgtgtgtaaaatgccaattaagaacactggtttcattccattgtaagcattagacagtgtatgtaggttgcaagagattgtgtagattatcactaaattttaactaccttcacttaatatgcttaaactgtcgccttaactatgctaagcatctagaataaaagccaaaatgtaactactgctgcctttctgaaacccaccatgcagttctgtattaactgaaatgttcagcagcccagagcagtttactgggagatactgagctatagcatagctgcttagttgcatttgagattttctagtcattgtgtaatggaaacttctttcttctaaaagttactggtatcactttctgagaaatgaatcactatatatttaatgtaaaaattcttataggaaataggacaaacttctgactcccttctttcatttttagattaagtgggataatacctaatttgggcattctactcttagcattatgtaaccgtgctactttggcatggtcatagaatgtttncctggtaatttgttccatgtcctgactcctccctgcaaacaaaatgatagttgacactttatcctgatttttttcttttttttggtttatgtctattctaattaaatatgtataaataaagttacattttagtctgtcaaaaaaaaaaaaaaaaaaaaaaaaaaaaaaa

SEQ ID NO: 146 - DNA, 831 bp, Homo sapiens
  exon (1)..(831)
atgtctctgtacccatctcttgaagacctgaaggtagacaaagtaattcaggctcagactgcctattctgcaaaccctgccaacccagcagttttgtctgaagcttctgctcctcccgtctctcaagatggaaatctctatcctaagttgtatccggagctctctcagtacatgggcctgagtttaaacgatgaagaaatacgtgcaaatatggccatgatccctggagcaccaattcaggggcaattggtagcaagaccttccagtatgaactatatggtggctcctgtaaccggcaatgatgttgggattcgtagagccgaaattaagcaagggattcgtgaagtcattctgtgtaaggatcaagatggaaaaattgggctccggcttaaatcaatagataacggagtatttgtgcagctagtccaggcaaattctccagcctcgctggttggcctgaggtttggggaccaagtactccagatcaacggggaaaactgtgcaggctggagctctgataaatcgcacaaggtgctcaaacaggcttttggagagaagattactatgactattcgtgacaggcccttcgaacggacaattaccatgcataaggatagtactggacatgttggttttatctttaaaaatggaaaaataacatccatagtgaaagatagttctgcagccagaaatggtctcctcacaaaacataacatctgccgagatcaatggatagaatgtcattgggctgaaggactctcaaattgcagacatactgtcaacatctgggactgtagttactattacaatctgccctgcttttatctttga

SEQ ID NO: 147 - DNA, 8461 bp, Homo sapiens
ctgatgaaacagcaaaagctagatattgtttcttctatacatagaaggaaatagcttcttgcaacaggaacaattcaggagaaaacagttgttttctcccctttagatgataggttgggaagcagggttggctccgtcataatgatttctcctaaacacttctcaggtttggcctatgcatgtgtgttatagattggggatagtttgaaaactcattctgtagtattattcctatgggcagggtggtgagtagtgtgtaaattctttgtcttctttatgggtcagtatatccacaggcacattttcatgctgctttgtcactgaaagtaaggcagctgcagtggcaggaccctgttctaggacagttgattgcctctatgatgagacctcagaatttcctctttcctagtgcccaagacaaggagctttgctgatgtatttctgatagcagaaaaggccattgagcttagtggttggtaccatatggcaatttacaatctgggaaatattctgatgatacatacttttcgaagaatgctagttagaatatttagataggactcctgaactttctttgagaagatgttgatgacaagaactaaaatcagcctaatctgggtcacatcccaggaaggataaaggtctataggtgtggaaggctctttctggtcctttcagtgagctatttccaatagagcccgcctatgcagagcttcccactcttgtgcataggatgtggttaagctcatgtctcagtgccacagtaggtagaggatgccattgcaatgtaaaagggctataaataaagctctcttgtttttccataaaacagtctgctctagaacagattataaaggggccagaaggaatctcttctcattttcttattgaatagagagtgtataaattattcccttacataaaggacaattactttttctatatagatcatatatagaaatagagctatagaaaaagtaattaattctatatgatatggcctcaatttttaatttttaaattgtttttatatgaaatagtcttaattttactctttttgcagttcacacaaagatgaattcctgcacttcaagattacattgtatatgtgattccttgcttcattttaaggactatgttgttttcttaaatgtgttgatgagtctttataacctgttttaataatgttaaattgaattcatttttcttattgttaatacaaaaacagtaaatttgaagactgagaaccatataagagggtgattgcacttattatgaaaagatttgaatccttctttgtgtgtgtgggtgtgaccagccttgctatcaatttcttctgtcatacactgccaaattttctatttaagtattgtgaaaactctgtttttttcaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccagaaaaggggcagaatcagtcacagagagagatactgaagttggtcatcaggcacatgaacatactgaacctgtatctctgtttcctgaagagtcttcaggggagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacggtctgaaagggaaatgacagattctactcctgtctttacagaaacaaatacattagaaaatttgggggcacagaccactgagcacagcagtatccatcaacctggggttcaggaagggctgaccactctcccacatagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagcgatttcagagcgattaggagaaccaaattatggggcagaaataaggggcttttccacaggttttcctttggaggaagatttcagtggcgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactataacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaacctatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaataatcaggcaactgtaagcactgcagagttaaatactgagcttgcaacaccatcattttcccttctggaaacttctaatgaaaccgatttcctgattggcattaatgaagagtcagtggagggcacagcagtctatttaccaggaccagatcgttgcaaaacgaacccgtgccttaacggaggcacctgttatcctactgaaacttcctacgtgtgcacctgtgtgccaggatacagcggcgaccagtgtgagcttgattttgatgaatgtcactctaacccctgtcgcaatggagccacgtgcattgacggtttcaatacgttcaggtgcctctgccttccgagctacattggtgcactttgtgagcaagacaccgagacatgtgactacggctggcacaaattccaagggcagtgctacaagtactttgcccaccgccgcacgtgggatgcagctgagcgagaatgccggctgcagggcgcccatctcacaagcatcctgtctcatgaagaacaaatgtttgtgaatcgtgtgggccatgactatcagtggataggcctcaatgacaagatgtttgagcatgacttccgttggactgatggcagcaccctgcaatatgagaactggaggcccaaccagccagacagctttttttctgctggagaagattgtgtcgtaatcatttggcacgagaacggccagtggaatgatgttccctgcaattaccatctcacctatacttgcaagaaaggaacagttgcttgcggccagcccccagttgtagaaaatgccaagacctttggaaagatgaaacctcgttatgaaatcaactccctgattagatatcactgtaaagatggtttcattcaacgccacccttccactatccgttgcctaggaaatggaaaatgggccatgcctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttctagcctatctaatttctttagttttctatttgcctccagtgcagtccatttcctaatgtataccagcctactgtactatttaaaaagctcaatttcagcaccaatggcaatgtaaataagatgatttaatgttgattttaatcctgtatataaaataaaaagtcatactgagttcgggcgtatttaatgatgattatggagccttagaggtctttaatcattggttcggctgctttttgtactttgtttaggctggaaacggtttcacttgccctttgtcagcaagactgaggacggcttttcctggacaactaacaaacaaaagtcttgtaggtcactgcgccatctcagccatagtagttgcagtttgcttccatgtgattctgaagcctggccaatgggatccggacaaaagtagggactgcaatgtgaaacacctctttgctgcattctttttcttcgcttacaagaaaggcctgaatggaggacttttttatgaccaggagcagtttttaggggtcaaagtgctaattattaactcaaccaggtctactttttaatggctttcataacactaactggcaagattacagatcaacacatttcaaatggatagagacctaggactctggagggtgggggattgttaaaaacac

SEQ ID NO: 148 - DNA, 6183 bp, Homo sapiens
  exon (1)..(6183)
atgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccagaaaaggggcagaatcagtcacagagagagatactgaagttggtcatcaggcacatgaacatactgaacctgtatctctgtttcctgaagagtcttcaggggagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacggtctgaaagggaaatgacagattctactcctgtctttacagaaacaaatacattagaaaatttgggggcacagaccactgagcacagcagtatccatcaacctggggttcaggaagggctgaccactctcccacatagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagcgatttcagagcgattaggagaaccaaattatggggcagaaataaggggcttttccacaggttttcctttggaggaagatttcagtggcgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactataacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaacctatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaataatcaggcaactgtaagcactgcagagttaaatactgagcttgcaacaccatcattttcccttctggaaacttctaatgaaaccgatttcctgattggcattaatgaagagtcagtggagggcacagcagtctatttaccaggaccagatcgttgcaaaacgaacccgtgccttaacggaggcacctgttatcctactgaaacttcctacgtgtgcacctgtgtgccaggatacagcggcgaccagtgtgagcttgattttgatgaatgtcactctaacccctgtcgcaatggagccacgtgcattgacggtttcaatacgttcaggtgcctctgccttccgagctacattggtgcactttgtgagcaagacaccgagacatgtgactacggctggcacaaattccaagggcagtgctacaagtactttgcccaccgccgcacgtgggatgcagctgagcgagaatgccggctgcagggcgcccatctcacaagcatcctgtctcatgaagaacaaatgtttgtgaatcgtgtgggccatgactatcagtggataggcctcaatgacaagatgtttgagcatgacttccgttggactgatggcagcaccctgcaatatgagaactggaggcccaaccagccagacagctttttttctgctggagaagattgtgtcgtaatcatttggcacgagaacggccagtggaatgatgttccctgcaattaccatctcacctatacttgcaagaaaggaacagttgcttgcggccagcccccagttgtagaaaatgccaagacctttggaaagatgaaacctcgttatgaaatcaactccctgattagatatcactgtaaagatggtttcattcaacgccacccttccactatccgttgcctaggaaatggaaaatgggccatgcctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctga

SEQ ID NO: 149 - DNA, 3446 bp, Homo sapiens
gccggcgggggcgcagcggcccgggaggtgcgtggttgagcgaagccgcggggcccaaccgcagtcgcggggtctgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtaaatgtgcggtgtagcccatacttgagagtatgaatgtatgtgcactgtcactttgctctgggtggaagtatgttattgttgacttattttctctgtgtttgttcctacagcccctttttcatatgttgcttggtctccctttccctccttggtgcttacacatttcaggccctttagccaaacccttgcctacggcagtattttagttctcagttctcaccattccctctggtcattgagcctttggataaaaactcatagagctatggactggggctttgctggaaaggtggccttccaacttcacgtcaacttctggctcctcagtttggcagtaaggcagggaagttgttttcccgtttctcagtgaccagattgtgaatatttcccaatggattttctattattaatgttactgtagttctttgttttgaaataaaaattctgaatgtaaaaaaaaaaaaaaaa

SEQ ID NO: 150 - DNA, 1494 bp, Homo sapiens
  exon (1)..(1494)
atggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaa

SEQ ID NO: 151 - DNA, 2228 bp, Homo sapiens
cggccaggctggtacaggcggctgctcgcggaggcacttctccgagcgtgacgtgcggactccgctccactgcggcccgcccgcccgccggtctagccgccgcctccttcgctccctgagcacgccaggcgagggtcagctgccggggcgacgcggcgcggagagggcgggcgggggggctgtgggagcgccggtctctatatggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcggcgagactggctgggaggagggcccagggccactgacggccacagaggacagtgccccaaaggagagcctcgggtgtcacgactgccacgccatcaaaaagtgccggaaatgggaagttttcaggatgacccaccaagtgcttttcccaagggtctgggctctgagttggaacccgcttgcctgcactccatcctgtctgcaacgctgcacgtgtatcccgaagtgctcctgagtgaggagacaaaacgcattttccttgaccgtttaaagcccatgttttcaaagcaaacaatagaattcaagaaaatgcttaaaagcacctcagatggtctgcagatgacactgggcttgctggctctacaagcttttgaattagcaaagccgtcacgccatagttaaggtacaagcagaacaataaaaatagtgagattaattttaaaaattgtcctagaatgatttcttttgcattaaatctggctgcagacagtgcagcccttaggttcctgctgtagttttgtacgacctggcagacttaaagtaaattgagtttaaattcaaagccagttgatgcggaaggaacttttttggcatgtgttaaattgtgctttaaaagacatataaagaattgggaaacatttcaggagacgatcatagcctgtataaataccagattagaacatacggatttaccatgaagttctgtcttcaacatccattctaaagggctactgtcccaaatcctgtgtgtccttttgacttgtctgatcacccaatggaagtggatacttgtaaagtctacaccactgtacttggcgttaaatcttgctgagttgctggtaggctgttaccatttctgcgttttgtaaaataattttggtctgcagcaatacttgatttcttttctcacatccctttccttccgcttgaaatgtgatttaaatggaggccctacggtgaaagttgcaatattaaacttacttttagaatagtccttcctcaaactaggaaccctagcagtgttaccttaaacaaaaatgagctcgagaaaaaagtagctcagttacagagaagcaaatcgagttatttcccacataaaaagtttcccagattctaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaatattactacaccgtgtgctattttagtgttttgggaaaatgaaaaataaaatctgttctttagcttaaaaaaaaaaaaaaaaaaaaaaaaaaaaa

SEQ ID NO: 152 - DNA, 207 bp, Homo sapiens
  exon (1)..(207)
atggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattga

SEQ ID NO: 153 - DNA, 4430 bp, Homo sapiens
tcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaattacctggtgatgaacttaacccaagagaatatgaagttgaaggactaaaacgcttagtgactgatatactgggtcgtcaagatggagacctgcaagactgggtcactgatgaccgcattggtaactggtggagaccaaattttgaacctcctcactatccatatattcctgcacacagtacaaaacataaggagcataagaatttgtttctggttcagcttcaagaaaaagccttgtttgcagtccctaaaaattacaagctggtagctgcaccattgtttgaattgtatgacaatgcaccaggatatggacccatcatttctagtctccctcagccgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaaaagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtgccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttggatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggtttgtcactgtaatacgagtcagcttctgtagcataaggtttgatttcctataattcttccacttgttttacatcacttattatttgggttaaagtggcctcacttcaagcagtttgcctttgttctttaaatatgtgatgagaaacaatgctgtaatttgacttgagccataaaacacaattttaatattagcttgtattatatttatcaaggttgtttttgtgaaaaaacaggctaaaacctaagtaagtctagattaagccaggttagctgtaatttgtattttagtgatggattgtattgtaagactagagataaattgggaaaatgtattatgcttttctgttgagggagagatcagtgcatttaaaaacttcaacttttgcttactgtgctcacatcatagtgtacaagcgtcatttatagtttggctttgaggatttttctggcattaagtttatagaaatgtataaaagaaagtgtttgaagttttggttatatttttatatttgtaaagtaagtttggttaaagtgatcactgttctttttttattttattgtcatttcaataaaaaatatttgaaagagaaaaaaaaaaaaaaaaa

SEQ ID NO: 154 - DNA, 684 bp, Homo sapiens
  exon (1)..(684)
atgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaattacctggtgatgaacttaacccaagagaatatgaagttgaaggactaaaacgcttagtgactgatatactgggtcgtcaagatggagacctgcaagactgggtcactgatgaccgcattggtaactggtggagaccaaattttgaacctcctcactatccatatattcctgcacacagtacaaaacataaggagcataagaatttgtttctggttcagcttcaagaaaaagccttgtttgcagtccctaaaaattacaagctggtagctgcaccattgtttgaattgtatgacaatgcaccaggatatggacccatcatttctagtctccctcagccgttgagcaggttcaattttatttacaactga

SEQ ID NO: 155 - DNA, 5183 bp, Homo sapiens
agttggaaagagaccacagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaggacctagcaacacttatgaagatcctcgaatgaactgtggtttccagtccaattatcaccagcaaagaccttgctaccccttttgggatgagatggcaactcaggaagttcctactggtcttgaacactgtgtctcagatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatggaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattcgcggtatcatgcaagttggtttttatttgctggctgaggattctgtcacagtgaaagaaaactgtttatatagaccccactggaaacgcaaagggctgtcactgagatcggggatcccaaattcatgtgacttatgtatgaaggaaaaaataatgctgatctgagtgcaagggaactgtgcatgtgaatttcatctataatttaaagaagttatcacaccctctacttatttgccattagtgaattctcggggtttggacttaacgttgagctaagaagcattaagtctttgaactgaatgtattttgcagccctggttttggaccacagtaaatgtaggagctctgttgacaccatggaaaggaggtcaaaggaggaagattgacttggttgtttattggttctatgcctataacatgtatgacttggaataaaggctgtgtgcatgggcattacccctcaggtctcaagaaataagtcctgaatgcatgtcattccgaactaacactctacactttctcctttatgttttattttccaagagtcctccattttttgcaccccctcaccgccaactctgttattcagtagagagaaatgtacagctttctgattgatgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaggctagttgaattggatgtcaggtgagagtgtgtatgcaaagtgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaacggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgcgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaacactccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttagagcattaacctgcctaatcttcatggtgaaaattacaccttctctattctagtcatgctgtgcatgctgctgtctctgttggggtctatataaatgtgttgaaatggtatctacattccaaagaagtttcaaggaaccataaatatatgtatacatatacatatataaaatatatatattaaaataaaattatcaggaatactgcctcagttattgaacttttttttttaagaatactttttttttaagctgagaagtataggggtgaaaaagatgttatattgtgtttgactattttccaacttgtattttcatataatttatattttttaaaagctgaaaatttaaaagcaagatgaaaaaaggaaaagcaggtgctttttaaaaatcagaactgaggtagcttagagatgtagcgatgtaagtgtctatgtgtttttaaaaaaaaatgcaaaaaaattcttatgggggagttttttgtttgtttattttagtagctgatgctggcacatcattttgctggagagttttttatatactgtagcctgatttcatattgtattttaaactgtgtgagattaaaaacaaagaatttcattcataaaaaaaaaaaaaaaaaaaaaaaaaaaaaaaaaaaaaaaaaa

SEQ ID NO: 156 - DNA, 1458 bp, Homo sapiens
  exon (1)..(1458)
atgagctactttgtggattctgctgggagcagccccgtcccttactcagcgcctcgtcctgcagtggtgaggcaaggacctagcaacacttatgaagatcctcgaatgaactgtggtttccagtccaattatcaccagcaaagaccttgctaccccttttgggatgagatggcaactcaggaagttcctactggtcttgaacactgtgtctcagatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtga

SEQ ID NO: 157 - DNA, 1302 bp, Equus caballus
  Oligonucleotide Sequence
  misc_feature (578)..(578): n is a, c, g, or t
agggcctgggaagccctaacaatcctgctgctgtcacggcagccccacagggaccccacacactgccctgggcaaggacagtgagctgtgcccaaggtccagattggctgaggctcctcccaccgctcctgtcctcgccaaactcagcttctctggactgtgacgacagccccagggctggctaccctgactgcctccccgcctccagtgtgatgcattttgtacccccttactttttatttatttattcttgctgaggaagattggccctgagctaacatctgtgccagtcttcctctatttttgtatgtgggtcgctgccacggcaccactgatgaatggtgtaggtccgcacccaggatctgaatctgaaccgtgtgtacccctttattttttcacaatacatgtcccacatggaaaaacagaacattctggtaagaaaaaaataattacagtcaaacctccaaacccaaaaaaccctacgcagtgacttaatatttctgtgtgaatctttccaggttttcacactctgagtacacagacacacacacctgtgcacgtgcacacacatgccttanaaaattatagtggtttgttacctgttagggtgttttagcttatttaatcctggacgtgaaacagggtaagctgccgtttctgagggctgcatggcttacacagcgtgaacgtaccataattttaaaatgctcatgtcttcatttgcttatccaagtgtaatttagaagtgaaattgctgagacagaagaaaagaagtatttttagaattttgatacttactgccaaattttctttcagggagtttgccccagtttgttgtcccttcggtggtgtatgaaactgtttgttttcccataactgagcctacgtgagatatttatattgtcttaataccttccaattttataaaaggaaaatagtctcttgtttcattatgcattcctttggttacttgtgatttgaatgtgtttttacttgtttaatggctttttttcttttggcagattgcttcagagacatgtgaaatcttcacatatgaaaatgtgtcactcgctttcttctgcaactctctagtgtcagcgtgtagagcccaatacttcccagtattttctaagactttaacgttttcttcctacctttgatttttaagtagtatttattttcaacctacttgaactatattttggaataaaatgtgaactatagagctagattgatttgtttatttaagttaataaattagaatggcccttcttttgttttggtatcagtaaaaaaaaaaaa

SEQ ID NO: 158 - DNA, 1880 bp, Homo sapiens
ctgcggagcccgtccgtgctgttctacggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctctctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggagcgagcagctggctaccgaaaggttattttgtaacatttgtctaacttcttacttgttttaagctttgcctcaggcggcaaacttcattttatgtgccattttgttgctgttattcaaatttcttgtaatttagtgaggtgaacgacttcagatttcattattggcttggatatttgaggtaaaacttcctttttgtttatatagtgctgactttttttgtttgaaattgaacagattggtaacctaaattgtggcctcctgactttttaaggaaacgtgcagccattacacacagcctaaagctgtcaagagattgactcaacattgccttcattccttaaaattaaaacctacgaaagttggtgtaaatttgtttgtatatgttatttacctgcagatctaaatggtaatctgaacccaaatttgtgtaagacttttcaggtgaaaagacttgatttttttgagaggattgttgaccaaacacaattctaatctcttctcttatgtatttttgtgcactaggcgcagttgtgtagcagttgagtaatgctggttagctgttaaggtggcgtgttgcagtgcagagtgcttggctgtttcctgttttctcctgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcagaaaaaaaaaaaaaaa

SEQ ID NO: 159 - DNA, 666 bp, Homo sapiens
  exon (1)..(666)
atgagctacggccgcccccctcccgatgtggagggtatgacctctctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaa

SEQ ID NO: 160 - DNA, 1387 bp, Homo sapiens
gctcagcatttggggacgctcgcagccctcggcgtccggcccagcttctatcaaaatgtctactgttcacgaaattctgtgcaagctcagcttggagggtgatcactctaccccggcaagtgcttacgggtcagtcaaggcgtacaccaacttcgatgccgagcgggatgcgctgaacattgaaacagccatcaagaccaaaggtgtggacgaggtcaccatcgtcaacattctgaccaaccgcagcaatgaacagagacaagatattgccttcgcctaccagagaaggaccaaaaaggagcttgcagcagcgctgaagtcagccttgtctggccacctggagacggtgattctgggcctgttgaaaacacctgctcagtatgatgcttctgagctgaaggcttccatgaaggggctggggaccgatgaggactccctcattgagatcatctgctcaaggaccaaccaggagctgcaggaaattaacagagtctacaaggaaatgtacaagactgatctggagaaggacatcgtttctgacacatctggtgacttccgcaagctgatggttgccctcgcaaagggtagaagagcagaggatggctctgtcattgattatgaactgattgaccaagatgcccgggatctctatgatgctggagtgaagaggaaaggaactgatgttccaaagtggatcagcatcatgaccgagcgcagtgtctgtcacctccagaaagtatttgaaaggtacaagagctacagcccttatgacatgttggagagcatcaagaaggaggtcaaaggagacctggaaaatgctttcctgaacctggtccagtgtattcagaacaagcccctgtattttgctgaccgactgtacgactccatgaagggcaagggcacgcgcgataaggtcctgatcagaatcatggtctcccgcagtgaagtggacatgttgaaaattaggtctgaattcaagagaaagtacggcaagtccctgtactactacatccagcaagacaccaagggcgactaccagaaggcgctgctgtacctgtgtggtggggatgactgaagcccgacacggcctgagcgtcaagaaatggtgctcaccatgcttcctgctaacagttctagaaaacagcttgcgactaacagcccccttgtgcccatccctgtgaggatgatgttagccttgtgcccccatccttattttagatgcctacgcgttacccggctttcccgtctagtctctccttttagccaaagaaatgaacattccaaggagttggcagtgaaatctatgatgtgaaacactttgcctcttgtgtactgtgtcgtaaacagatgaataaactgagtttttactttaaaaaaaaaaaaaaaa

SEQ ID NO: 161 - DNA, 1020 bp, Homo sapiens
  exon (1)..(1020)
atgtctactgttcacgaaattctgtgcaagctcagcttggagggtgatcactctaccccggcaagtgcttacgggtcagtcaaggcgtacaccaacttcgatgccgagcgggatgcgctgaacattgaaacagccatcaagaccaaaggtgtggacgaggtcaccatcgtcaacattctgaccaaccgcagcaatgaacagagacaagatattgccttcgcctaccagagaaggaccaaaaaggagcttgcagcagcgctgaagtcagccttgtctggccacctggagacggtgattctgggcctgttgaaaacacctgctcagtatgatgcttctgagctgaaggcttccatgaaggggctggggaccgatgaggactccctcattgagatcatctgctcaaggaccaaccaggagctgcaggaaattaacagagtctacaaggaaatgtacaagactgatctggagaaggacatcgtttctgacacatctggtgacttccgcaagctgatggttgccctcgcaaagggtagaagagcagaggatggctctgtcattgattatgaactgattgaccaagatgcccgggatctctatgatgctggagtgaagaggaaaggaactgatgttccaaagtggatcagcatcatgaccgagcgcagtgtctgtcacctccagaaagtatttgaaaggtacaagagctacagcccttatgacatgttggagagcatcaagaaggaggtcaaaggagacctggaaaatgctttcctgaacctggtccagtgtattcagaacaagcccctgtattttgctgaccgactgtacgactccatgaagggcaagggcacgcgcgataaggtcctgatcagaatcatggtctcccgcagtgaagtggacatgttgaaaattaggtctgaattcaagagaaagtacggcaagtccctgtactactacatccagcaagacaccaagggcgactaccagaaggcgctgctgtacctgtgtggtggggatgactga

SEQ ID NO: 162 - DNA, 2229 bp, Homo sapiens
agtgactctccgaggcggcggcagagacagaagagcggggtcggggccggctgaccaggaacctgggcgagcagcggcgggggccagagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatactccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaggatcctaactatgatgatgaccaggagaactgtgtttatgaaactgtggttttgcctttggatgaaacggcatttgagaaaactttaacaccaatcatacaggaatattttgagcatggagatactaatgaagttgcggaaatgctaagagatttaaatcttggtgaaatgaaaagtggagtaccagtgttggcagtgtccttggcattggagggaaaggctagtcacagagaaatgacatctaagctcctttctgacctttgtgggacggtaatgagcacaaacgatgtagaaaagtcatttgataaattgttgaaagatctacctgaattagcactggatactcctagagcaccacagttggtgggccagtttattgctagagctgttggagatggaattttatgtaatacctatattgatagttacaaaggaactgtagattgtgtacaggctagagctgccctggataaggctactgtgctcctgagtatgtctaaaggtggaaagcgcaaagacagtgtgtggggctctggaggtgggcagcagtctgttaaccaccttgttaaagagattgatatgctgctgaaagaatatttactctctggagacatatctgaggctgaacattgccttaaggaactggaagtacctcattttcaccatgagcttgtatatgaagccattgtaatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttcttttttttttgtttttcgagggggcaaggagggacagaaaagtaaccacttcttaagtggaatattctcataagctaccttttgtaagtgccatgtttatgacctaatcattccaagttttgcattgatgtctgactgccactcctttctttcaaggacagtgtttttgtagtaaaatcactggtttatacaaagctttatttagggggtaaagttaagctgctaaaaccccatgttggctgctgctgttgaaatactgtgctttgggagtaaaaaaagaaagttatttctttgtcttaaagaattttaagaaaacgagttagtcacaagacttattcatctttccagggagcatactgattggtcttaaagactagacagttaagtaaatggtggccggaacatctatttttctacaaactggaaaaatgaacccagttctagaagaatgtatgacaaaataaaacatgtgaagcagtaaaaaaaaaaaaaaaa

SEQ ID NO: 163 - DNA, 1410 bp, Homo sapiens
  exon (1)..(1410)
atggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatactccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaggatcctaactatgatgatgaccaggagaactgtgtttatgaaactgtggttttgcctttggatgaaacggcatttgagaaaactttaacaccaatcatacaggaatattttgagcatggagatactaatgaagttgcggaaatgctaagagatttaaatcttggtgaaatgaaaagtggagtaccagtgttggcagtgtccttggcattggagggaaaggctagtcacagagaaatgacatctaagctcctttctgacctttgtgggacggtaatgagcacaaacgatgtagaaaagtcatttgataaattgttgaaagatctacctgaattagcactggatactcctagagcaccacagttggtgggccagtttattgctagagctgttggagatggaattttatgtaatacctatattgatagttacaaaggaactgtagattgtgtacaggctagagctgccctggataaggctactgtgctcctgagtatgtctaaaggtggaaagcgcaaagacagtgtgtggggctctggaggtgggcagcagtctgttaaccaccttgttaaagagattgatatgctgctgaaagaatatttactctctggagacatatctgaggctgaacattgccttaaggaactggaagtacctcattttcaccatgagcttgtatatgaagccattgtaatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactga

SEQ ID NO: 164 - DNA, 1299 bp, Homo sapiens
gtttgatggcgtgatgtctcacagaaagttctccgcccccaggcacgggtccctgggcttcttgcctcggaaacgcagcagccggcaccgcggcaaggtgaagagtttccccaaggatgacgcttcgaagcccgtgcacctcacggccttccttggctaccagggcggcatgacccacatcctgcgtgaagtccataggcccggattccaagtgaaccagaaagaagttgtggaagctgtgaccattgtggagacgccacccatggtggttgtgggcattgtgggctacgtggaaacccctcggggccctcgtaccttcaagaccatctttgctgagcacataagtgatgagtgcaaaaggcgcttctacaagaactggcataagtctaagaagaaggccttcaccaaatactgcaagaagtggcaggatgaggacggcaggaagcagctggagaaggatttcagcagcatgaagaagtactgccaggtcatccgtgtcatcgcccacacccagatgcgcctgctccctctgcgccagaagaaggcgcatctcatggagatccaggtgaacggaggcacagtggccgagaaactggactgggcccgcgagaggctggagcagcaggtccctgtgaaccaggtgtttgggcaggacgagatgatcgacgtcatcggggtgaccaagggcaaaggctacaaaggggtcaccagccgctggcacaccaagaagctgccccgcaagacccaccgagggctgcgcaaggttgcctgcattggggcctggcatcccgcccgagtggccttctccgtggcgcgggccgggcagaagggctaccatcaccgcacggagatcaacaagaagatctacaagattggccagggctacctcatcaaggacggcaagctgatcaagaacaatgcctccactgattacgacctgtctgacaagagcatcaaccctctgggtggctttgtccactacggtgaagtgaccaacgactttgtcatgctgaaaggctgtgtggtgggaaccaagaagcgagtgctgacccttcgcaagtccctgctggtgcagacgaagcggcgggccctggagaaggttgacctcaagttcatcgacaccacctccaagtttggccatggccgcttccagactgtggaggagaagaaagcattcatgggaccacttaagaaagaccgaattgcaaaggaggaaggagcttgatgccagcatcagatcgtgcagctggtggggtcccaataaaagttattttccactgaaaaaaaaaaaaaaaaaaa

SEQ ID NO: 165 - DNA, 1212 bp, Homo sapiens
  exon (1)..(1212)
atgtctcacagaaagttctccgcccccaggcacgggtccctgggcttcttgcctcggaaacgcagcagccggcaccgcggcaaggtgaagagtttccccaaggatgacgcttcgaagcccgtgcacctcacggccttccttggctaccagggcggcatgacccacatcctgcgtgaagtccataggcccggattccaagtgaaccagaaagaagttgtggaagctgtgaccattgtggagacgccacccatggtggttgtgggcattgtgggctacgtggaaacccctcggggccctcgtaccttcaagaccatctttgctgagcacataagtgatgagtgcaaaaggcgcttctacaagaactggcataagtctaagaagaaggccttcaccaaatactgcaagaagtggcaggatgaggacggcaggaagcagctggagaaggatttcagcagcatgaagaagtactgccaggtcatccgtgtcatcgcccacacccagatgcgcctgctccctctgcgccagaagaaggcgcatctcatggagatccaggtgaacggaggcacagtggccgagaaactggactgggcccgcgagaggctggagcagcaggtccctgtgaaccaggtgtttgggcaggacgagatgatcgacgtcatcggggtgaccaagggcaaaggctacaaaggggtcaccagccgctggcacaccaagaagctgccccgcaagacccaccgagggctgcgcaaggttgcctgcattggggcctggcatcccgcccgagtggccttctccgtggcgcgggccgggcagaagggctaccatcaccgcacggagatcaacaagaagatctacaagattggccagggctacctcatcaaggacggcaagctgatcaagaacaatgcctccactgattacgacctgtctgacaagagcatcaaccctctgggtggctttgtccactacggtgaagtgaccaacgactttgtcatgctgaaaggctgtgtggtgggaaccaagaagcgagtgctgacccttcgcaagtccctgctggtgcagacgaagcggcgggccctggagaaggttgacctcaagttcatcgacaccacctccaagtttggccatggccgcttccagactgtggaggagaagaaagcattcatgggaccacttaagaaagaccgaattgcaaaggaggaaggagcttga

SEQ ID NO: 166 - DNA, 960 bp, Homo sapiens
cctttccgtctggcggcagccatcaggtaagccaagatgggcgcttacaagtacatccaggagctatggaggaagaagcagtcggacgtgatgcgatttcttctcagggtgcgctgctggcagtaccgccagctctcggcgctccacagggcgccccgccccacccggcccgataaggcgcgcagactgggctacaaggccaagcaaggttatgtcatatatcgcattcgtgtgcgccgtggtggccgcaaacgccccgttcctaagggcgcgacctacggcaagcctgtgcatcatggtgttaaccagctcaagtttgctcgaagccttcagtctgttgccgaggaacgagctggacgccactgtggggctctgagagttctgaattcttactgggttggcgaagattccacatacaaattctttgaggtgatcctcattgatccattccataaggctattagaagaaatcctgatacccagtggatcaccaaaccagtccacaagcacagggaaatgagagggctgacatctgcaggccgcaagagccgtggccttggaaagggccacaagttccaccacactattggtggttctcgccgtgcagcttggagaaggcgcaatactctgcagcttcaccgttaccgctaatataagtaatgtttgtaaaattcttacctaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctccaaaaaaaaaaaaaaaaaaaaaaaaaaaaaaa

SEQ ID NO: 167 - DNA, 615 bp, Homo sapiens
  exon (1)..(615)
atgggcgcttacaagtacatccaggagctatggaggaagaagcagtcggacgtgatgcgatttcttctcagggtgcgctgctggcagtaccgccagctctcggcgctccacagggcgccccgccccacccggcccgataaggcgcgcagactgggctacaaggccaagcaaggttatgtcatatatcgcattcgtgtgcgccgtggtggccgcaaacgccccgttcctaagggcgcgacctacggcaagcctgtgcatcatggtgttaaccagctcaagtttgctcgaagccttcagtctgttgccgaggaacgagctggacgccactgtggggctctgagagttctgaattcttactgggttggcgaagattccacatacaaattctttgaggtgatcctcattgatccattccataaggctattagaagaaatcctgatacccagtggatcaccaaaccagtccacaagcacagggaaatgagagggctgacatctgcaggccgcaagagccgtggccttggaaagggccacaagttccaccacactattggtggttctcgccgtgcagcttggagaaggcgcaatactctgcagcttcaccgttaccgctaa

SEQ ID NO: 168 - DNA, 705 bp, Equus caballus
  Oligonucleotide Sequence
ggacgtcagtgagagcagagatggctgtgggtgtggagtgagggttctactgtgaggtgagctgctcactgccgaggagagttaccgcaacctgcactccgcggccacctcacactctcgacttgtccaaactgaattctttctttcctttacccgaacttgttatccctttcagcgtgggttaaggtgggcacaggaggtttatgaaccccctgaaattgtatatggaagttggtgtatatatggcaaatgtatttttttttcccctaaggaaagggtccatattattcatcagattctgaatgggatctgtaatagaaaagtttaaaaattcctattttgtagggatatagaaaatttaaaagggattttagaagaaatatacaaagataaatctggggggagtcagtgaggaaaaaattaaggaactgtgatttaatctggagaatggaataaatttaagatatgtagggtataaggaagaacttgaaagattctagaaagggtcagaaagttaatatttatatatgtgaaaaagtctgaggagagtaattctcatttaattctctacgtaccttgcaacttaaattatcccattgctcctagtatagaacatccttatccagaacaagtttgcacaaaatttatctcagtgtgcatttgtttcttttatttttatctaacttatttctatattataaaata

SEQ ID NO: 169 - DNA, 576 bp, Equus caballus
  Oligonucleotide Sequence
gtagatgatcattggtgagtgggcatggacaggaaaaaaagagtctgaagttaagtgcaagaagaaatgagcaggtaaagccaacgtttttgcttcaaatgttgcaatgagatggaagaataggctgcttgatgtgtattaaaagaatgcttggtacaaggggaaaaagttgtatcttggctgcaagataccatttaagaatatcctagtgaagttatttgactatgggtttggcaggacttctgaaaaaagaaaataataataaccatgatatacatagccatggttaatctgtttgcttttcacttactttacaagtataataaaacttgccaaaacaagtcgttatccatctttctttttcttttttttttttgcagggaccttgctgcctttgataaatcccatgatcaagccatccgtacctaccaagagcacagagcaagtatgcaccctgtgactgccatgctggtgggaaaagatttaaaagtggattaaggacctgcctattgctgattccacacatttctcttttttacattgaattcataaataaatatgaaacttcagcttgca

SEQ ID NO: 170 - DNA, 2341 bp, Homo sapiens
ggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccactttggaatgaatgcaacttctagccagtttttcctgcaagaaatccagttggatatgactcttcctgacgccagagaccccaccttcaaggctgccaacagctcgctgagggcacttcaggccaccatcgggaactcctacaggtgtaatgccgaggagcgcctgcgcgtcacagaggccctttctgtcaacgtcttcagagtgtgggttcaggctttccaggtggaaggtgacaagtttgggtccgtggaggaatgccagctggatgagaacaacatgatgatccccattgccgtgggcggtgccctggccgggctggtcctcatcgtcctcattgcctacctcatcggcaggaagaggagccacgcgggctaccagactatctagcctggtgcacgcaggcacagcagctgcaggggcctctgttcctttctctgggcttagggtcctgtcgaaggggaggcacacttgcctgcacacgatttccaaatctgctttatccaatttgaagttcatcttgcaacatttactatgcacaaaagagtaactattgaaatgacggtgttaattttgctaactgggttaaatattttgctaactggttaaatgttaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatctaagccttacaaagggagagtctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagagctggcacttttttaaatagcaaactgggtgttatttttatttacttctttgtaaagtggttttcggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttttaaaaaaaaaaaaaaaaaaaaaaaa

SEQ ID NO: 171 - DNA, 1254 bp, Homo sapiens
  exon (1)..(1254)
atggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccactttggaatgaatgcaacttctagccagtttttcctgcaagaaatccagttggatatgactcttcctgacgccagagaccccaccttcaaggctgccaacagctcgctgagggcacttcaggccaccatcgggaactcctacaggtgtaatgccgaggagcgcctgcgcgtcacagaggccctttctgtcaacgtcttcagagtgtgggttcaggctttccaggtggaaggtgacaagtttgggtccgtggaggaatgccagctggatgagaacaacatgatgatccccattgccgtgggcggtgccctggccgggctggtcctcatcgtcctcattgcctacctcatcggcaggaagaggagccacgcgggctaccagactatctag

SEQ ID NO: 172 - DNA, 785 bp, Equus caballus
  Oligonucleotide Sequence
gatgcctgcaatacctcttatcatcgttgtaacatttcttccaaaattaatgacccaacccgtcctctctgggccagagttaaagcgaggcttggacaagaagaatcggcctatgcagactcaaaagagtttatcctgtgccagcacgggaaaattggaccacctaaactggatatcagaaagaaagacgaccagatcattattgacatatctcaccctttatttgctgtaaatggatttgacctggaagccatgtatgatgatgaaaatgcttgttacgaattcgtgtacaaggtgtatgtgaaaataaacggaagtggagagagcatggagagagtgtatgaatgcagagacgaggactgcaatgagacccactgccgcctcggcatcccagcgtcctccctgaactctcagtgctgcgctgcagcagagggagtctcggaacgatgggagttcacaactgacaagtccgaagaactctgcctgaccgttttcgatgatggcagcccagaaggttcggtttggattccagttgttgctgctttcctactctttctagtcattctgctggttgcgtgttgttattgtcgcattaagacgaagaatctgtttaagagaagaaacaaccctttacccagttccttgctgtctgtggtaagaagtgcctcttcagagccagactctgaatcaaagcatatatcgcctgtcacctaccagccaattgtcccggagaacgatcacctgtcttcagcagcggtgtcagggacgcaggctgaagacagtcc

SEQ ID NO: 173 - DNA, 632 bp, Equus caballus
  Oligonucleotide Sequence
gtggacgaaggtgggaaggagttccctgatcggctacagactgacagctgactcccaggagttctcctgagctcagccgaggggcccggccctgaaggaagggctctgcctgagcagttcttcctgaacggctttgagtttgtgaaaagatctgatttctggaattgtgtcaatattaaccacatgcaatgtctggttcagatcaaaatgtgaactgcctgttgaacttggtcgcatttggtctgaaaacagcaaaccagtttcaaaacctgtcttaggaaaacaagcgacatcagcacctgggagcctttctcccggcacggccagctgtgacagtggcactccctgccaccctcttcctgcgacagcggtggcatctgtggcggatgtttcttctctgcgcctccgtgtgggatttggtttggaagtttgtgtagatagtacttttaaatacctgcttttggaagaaatcctggaagcttttcaaaactggcatttaaaatcagatttgagccagtggaattaatagagggtgtaaatagagacgtgcatgtgtcttccaggagcattgcacgttgcctgtagaaagttttaaataaaacatttttaaaattaaaaaaaaaaaaaaaaaa

SEQ ID NO: 174 - DNA, 4821 bp, Homo sapiens
aagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgttgtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaaccagctgtctcttctggaaaaagaacatgatttagaacgccggtatgaactgctgaatcgggaattgcgggcaatgctggccattgaagactggcagaagaccgaggcccagaagcgacgcgagcaactcctgctggatgagctggtggccctcgtgaaacagcgcgacgcgctagtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccatatctaacactgactctgttacctaaattttatagttagatcatattcaatctgcttattaaactgtgttctatttaccagtgggattttctgcagttgttttgcgtttcactgtaaggataatagagctcctctcctctgctttcttcagaggatggctctgtaacctagcctgagacaagtcctgtgatttaaaggtgagctgtgaggatgggactaattgacatgcatcagtttacaaagacgggcttatcatctgagaatgcgccatctttttctctggataattatttattacttctagcttggttcctacaattttgttgggtctcaacattggctcaagaatgctgttaatatttattctgtattgataaaagtctgtcttgccactatgagtaaatcccccaattaatattttcttctctagcatcgcactgtcattttttgtgaaaatggttatctgtttatttattacatatctgagtcatatataaattttcaataaaagcagaaactttcttaccttaaaaaaaaaaaaaaa

SEQ ID NO: 175 - DNA, 3483 bp, Homo sapiens
  exon (1)..(3483)
atggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgttgtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaaccagctgtctcttctggaaaaagaacatgatttagaacgccggtatgaactgctgaatcgggaattgcgggcaatgctggccattgaagactggcagaagaccgaggcccagaagcgacgcgagcaactcctgctggatgagctggtggccctcgtgaaacagcgcgacgcgctagtcagggacctggacgcgcaggagaagcaggccgaagaagaagatgagcatttggagcgaactctggagcaaaacaaaggcaagatggccaagaaagaggagaaatgtgttcttcagtag

SEQ ID NO: 176 - DNA, 2323 bp, Homo sapiens
  Oligonucleotide Sequence
ctccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctctcactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcactctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccgacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgtt

SEQ ID NO: 177 - DNA, 1158 bp, Homo sapiens
  Oligonucleotide Sequence
  exon (1)..(1158)
atgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctctcactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcactctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaa

SEQ ID NO: 178 - DNA, 1518 bp, Homo sapiens
gaaactttcacgcgagcgggaaatatgggatgtataaaatcaaaagggaaagacagcttgagtgacgatggagtagatttgaagactcaaccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacattgagaggaaaaactacattcaccgggacctgcgagcagcaaacgtcctggtctccgagtcgctcatgtgcaaaattgcggattttgggcttgctcgagtgattgaagataacgagtacacagcaagggaaggtgctaaattccccatcaagtggactgctccagaagcaatcaattttggatgtttcactattaagtctgacgtgtggtccttcggaatcctcctgtatgaaatcgtcacctatgggaaaatcccctacccagggagaactaatgccgacgtgatgactgccctgtcacagggctacaggatgccccgcatggagaactgcccagatgagctctatgacatcatgaaaatgtgctggaaagaaaaggcggaagagaggccgacgtttgattacttacagagcgtcctggatgatttctacactgccacggaagggcagtatcagcagcagccttagagcgcaggaagacccgtc

SEQ ID NO: 179 - DNA, 1476 bp, Homo sapiens
  exon (1)..(1476)
atgggatgtataaaatcaaaagggaaagacagcttgagtgacgatggagtagatttgaagactcaaccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacattgagaggaaaaactacattcaccgggacctgcgagcagcaaacgtcctggtctccgagtcgctcatgtgcaaaattgcggattttgggcttgctcgagtgattgaagataacgagtacacagcaagggaaggtgctaaattccccatcaagtggactgctccagaagcaatcaattttggatgtttcactattaagtctgacgtgtggtccttcggaatcctcctgtatgaaatcgtcacctatgggaaaatcccctacccagggagaactaatgccgacgtgatgactgccctgtcacagggctacaggatgccccgcatggagaactgcccagatgagctctatgacatcatgaaaatgtgctggaaagaaaaggcggaagagaggccgacgtttgattacttacagagcgtcctggatgatttctacactgccacggaagggcagtatcagcagcagccttag

SEQ ID NO: 180 - DNA, 876 bp, Homo sapiens
acttccccttcctgtacagggcaggttgtgcagctggaggcagagcagtcctcactgcggggagcctggagcgaacatggatcaagaaaccgtgggcaatgttgtcctgctggccatcgtcaccctcattagcgtgatccagaatgggttcttcgcccacaaggtggaacacgaaagcaagactcagaatgggcggagcttccagaggacgggaacacttgcctttgagcgggtctacactgccaaccaaaactgtgtagacgcgtaccccactttccttgtcatgctctggagcgccgggctactctgcagccaagttcctgccgcctttgctgggctgatgtacctgttcgtgaggcagaagtacttcgtgggctatctgggagagagaaggcagagcacacccggctacatatttgggaaacgcatcatactgttcctgttcctcatgtcccttgctggaatattcaactattatctcatcctctttttcggaagtgactttgaaaactacataaagacgataaccaccaccatctcccctctacttctcattccctaactctctgctgaatacagggttggtgctctcatctaatcaatacctacaagtcatcataattcagctcttgagagcattctgctcttctttagattgctgtaaatctaatgaccatctgggcttcgcgtcttgagttaaccttgcttttcctggaacaaaatgatgtcatgtcagctccgccccttgaacatgaccgtggcctcagatttgttattcagatccattctgtgtgtttcttgacttaccctgctttctgaagatattttgtgacccagatttatgttttcctaaaataaaatgcagagacatgtttt

SEQ ID NO: 181 - DNA, 486 bp, Homo sapiens
  exon (1)..(486)
atggatcaagaaaccgtgggcaatgttgtcctgctggccatcgtcaccctcattagcgtgatccagaatgggttcttcgcccacaaggtggaacacgaaagcaagactcagaatgggcggagcttccagaggacgggaacacttgcctttgagcgggtctacactgccaaccaaaactgtgtagacgcgtaccccactttccttgtcatgctctggagcgccgggctactctgcagccaagttcctgccgcctttgctgggctgatgtacctgttcgtgaggcagaagtacttcgtgggctatctgggagagagaaggcagagcacacccggctacatatttgggaaacgcatcatactgttcctgttcctcatgtcccttgctggaatattcaactattatctcatcctctttttcggaagtgactttgaaaactacataaagacgataaccaccaccatctcccctctacttctcattccctaa

SEQ ID NO: 182 - DNA, 3056 bp, Homo sapiens
cggcacgaggcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcatcgatgaatttgacaagatgtctgacatggaccgcacggccatccacgaagtgatggagcagggtcgagtcactatcgccaaggctggcatccatgctcgactgaatgcccgctgcagtgttttagcagctgccaaccccgtctatggcaggtatgatcagtacaagacccctatggagaacatcgggctgcaggactccctgctctcccgatttgacttgctcttcatcatgctggatcagatggaccctgagcaggatcgggagatctcggaccatgtccttaggatgcaccgttacagggcacctggggagcaggatggcgatgctatgcctttgggtagtgctgtggatatcctggctacagacgatcccaactttagccaggaagaccagcaggacacccagatttatgagaagcatgacaaccttctgcatgggaccaagaagaaaaaggagaagatggtgaatgcagctttcatgaagaagtacatccacgtggccaaaatcatcaagcccatcctaacacaggagtcagctgcttacattgcagaagagtactcccgcctgcgcagccaagacagcatgagctcggacaccgccaggacatctccagttacagcccggacgctggaaactctgattcgcttagccacagcccatgccaaggctcgcatgagcaagacggtggacctgcaggacgccgaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggagtcggtggaagccttgggaatgggcaatgaaagctgccgtgaggtaaagagaagaaagtaggaaggaccaagactattgcttcttcattgcaaaagcactggctcatccgccctacttcccatcccacacaaacccaattgtaaataacatatgacttctgattaatttcgggggcacaactgttttctgtttgctgtttttttgttttgttttcttcctcccgagcactttggtccagaataggctttggattgttttatgctgctggagagaagctctgaggcaagtcatggaggccaaaaaagcttatgtgcagtagcatcagttaaggtgaatatgtattgtatcacaaaacaaacccaatatccagatgaatatccaagacattgaataaacttacccatttcgtacaaaaaaaggggggcccggtaaac

SEQ ID NO: 183 - DNA, 2427 bp, Homo sapiens
  exon (1)..(2427)
atggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcatcgatgaatttgacaagatgtctgacatggaccgcacggccatccacgaagtgatggagcagggtcgagtcactatcgccaaggctggcatccatgctcgactgaatgcccgctgcagtgttttagcagctgccaaccccgtctatggcaggtatgatcagtacaagacccctatggagaacatcgggctgcaggactccctgctctcccgatttgacttgctcttcatcatgctggatcagatggaccctgagcaggatcgggagatctcggaccatgtccttaggatgcaccgttacagggcacctggggagcaggatggcgatgctatgcctttgggtagtgctgtggatatcctggctacagacgatcccaactttagccaggaagaccagcaggacacccagatttatgagaagcatgacaaccttctgcatgggaccaagaagaaaaaggagaagatggtgaatgcagctttcatgaagaagtacatccacgtggccaaaatcatcaagcccatcctaacacaggagtcagctgcttacattgcagaagagtactcccgcctgcgcagccaagacagcatgagctcggacaccgccaggacatctccagttacagcccggacgctggaaactctgattcgcttagccacagcccatgccaaggctcgcatgagcaagacggtggacctgcaggacgccgaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctga

SEQ ID NO: 184 - DNA, 4409 bp, Homo sapiens
tttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctgaggagatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttgctgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcatttt

SEQ ID NO: 185 - DNA, 3078 bp, Homo sapiens
  exon (1)..(3078)
atggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctgaggagatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaa

SEQ ID NO: 186 - DNA, 2714 bp, Homo sapiens
ggagcataatgctaaagaagtaaacaggtcatggcacgtttaacaaaaagacgacaggcgatacaaaagctatccagcatctttgggcagccattgagattatacggaaccagaagcagattgccaacattgaccgtattacaaaatgtgaaacaactacattattcttgaacctatggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgccgagcacaagcgcacctgccgccggaagagatgaaggcggctcttcctgggagcgccgacgacgactcttctcagacacagcggtttttgtttccaagaagccaaaattgtttagaatttgcttcccattttgcaccagcctttaaacacttttcgtgaagaaattttgcacagtagtttaaatcttttgttaatgctcctccagagtttttcagggggtaaaagtaacatcagtggagggtattattttaaataaactttagtgagaatttgttgcattttcagcaaattttaaaacatttttaggttttacagagattttaacctttaaacaaaagatctttaaaaaacaacaggtgaatacaagtgagtttaacaaagaagcatttaaagtagatctgaatgtgagaactgtttcagaaataaaacatactaccttgatgtgaaatttatttcttaaccttgttgagctggttttgttcagcttaatttactgtttaaaggcattatctattggttatgccagtgggtatatgattgaatttagggaacagggttgacacagcaggtgctagtcctgcatattttttcgtaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaaacaacaaaaacaaagcct

SEQ ID NO: 187 - DNA, 1689 bp, Homo sapiens
  exon (1)..(1689)
atgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgccgagcacaagcgcacctgccgccggaagagatga

SEQ ID NO: 188 - DNA, 1092 bp, Homo sapiens
ctgcaaggcggcggcaggagaggttgtggtgctagtttctctaagccatccagtgccatcctcgtcgctgcagcgacaccgctctcgccgccgccatgactgagcagatgacccttcgtggcaccctcaagggccacaacggctgggtaacccagatcgctaccaccccgcagttcccagacatgatactgtcggcctcgcgagacaagaccatcatcatgtggaagctgaccagggatgagaccaactacggcatcccacagcgtgctcttcgaggtcactcccactttgttagtgacgtggtgatctcttcagatggccagtttgccctctcaggctcctgggatggaacgcttcgcctctgggatctcacaacgggcaccaccacacgccgatttgtgggccataccaaggatgtgctgagtgtggcattctcctctgacaaccggcagattgtctctggctcccgagataaaaccatcaagctatggaatactctgggtgtatgcaaatacactgtccaggatgagagccactcggagtgggtgtcttgtgtccgcttctcacccaacagtagcaatcccatcattgtctcctgtggctgggacaagctagtcaaggtgtggaatttggcaaactgcaagctgaagaccaatcacatcggccacacaggctacctgaacactgtcactgtctctccggatggatccctctgtgcttctggaggcaaggatggccaggccatgctttgggatttaaatgaaggcaagcacctttacacactagatggtggggacatcatcaacgccttgtgcttcagtcccaatcgctactggctctgtgctgccacaggccccagcatcaagatctgggacttggagggcaagatcattgtagatgaactgaagcaagaagttatcagtaccagcagcaaggcagagccaccccagtgcacttctcttgcctggtctgctgatggccagactctgtttgctggctacacggacaacctggtgagagtgtggcaggtgaccatcggcacccgctagaaatacatggcaagctttagaaataaaaaaaaaatggcttttc

SEQ ID NO: 189 - DNA, 954 bp, Homo sapiens
  exon (1)..(954)
atgactgagcagatgacccttcgtggcaccctcaagggccacaacggctgggtaacccagatcgctaccaccccgcagttcccagacatgatactgtcggcctcgcgagacaagaccatcatcatgtggaagctgaccagggatgagaccaactacggcatcccacagcgtgctcttcgaggtcactcccactttgttagtgacgtggtgatctcttcagatggccagtttgccctctcaggctcctgggatggaacgcttcgcctctgggatctcacaacgggcaccaccacacgccgatttgtgggccataccaaggatgtgctgagtgtggcattctcctctgacaaccggcagattgtctctggctcccgagataaaaccatcaagctatggaatactctgggtgtatgcaaatacactgtccaggatgagagccactcggagtgggtgtcttgtgtccgcttctcacccaacagtagcaatcccatcattgtctcctgtggctgggacaagctagtcaaggtgtggaatttggcaaactgcaagctgaagaccaatcacatcggccacacaggctacctgaacactgtcactgtctctccggatggatccctctgtgcttctggaggcaaggatggccaggccatgctttgggatttaaatgaaggcaagcacctttacacactagatggtggggacatcatcaacgccttgtgcttcagtcccaatcgctactggctctgtgctgccacaggccccagcatcaagatctgggacttggagggcaagatcattgtagatgaactgaagcaagaagttatcagtaccagcagcaaggcagagccaccccagtgcacttctcttgcctggtctgctgatggccagactctgtttgctggctacacggacaacctggtgagagtgtggcaggtgaccatcggcacccgctag

SEQ ID NO: 190 - DNA, 4349 bp, Homo sapiens
gggggctgcaggaagccgccgcgccgccgcttttgttgtcagggacccagcgaggagcgccgctcgccggccgccgccaccctctctcgctgcagcctgctgtgcgctgcacggcctggggcccgggagccccgcccgctctgcccatgagggggccccgcgaccaccgctgcttccagcccggggcggcgcggcgctgaggcggcggcggcggcgctgccccctctgcgggaagcgggcggccccggccgcctccgcgagggcaccatggaggtgaatgcaggaggtgtgattgcctatatcagttcttccagctcagcctcaagccatgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagcccaagagaggagaacggattcgcaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtttgtccaatgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttatactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgttctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaaaacatgtattttagagttcatctttggcaaaatctttggttcagggtactagttgtttaaaagttgattcatattcttaccttgtgctgagaaaggttgcattgctgccccttatacacatgctgcagcttgatgttaaagaatttttattctttctgaagaactaattaatgtttaaagcaactgtttaatatgatggcatgtgtgtgtgtgcgtgcgtgtgtatgttctgagtccacttcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtattaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactctcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcaaaaaaaaaaaaaaaa

SEQ ID NO: 191 - DNA, 1740 bp, Homo sapiens
  exon (1)..(1740)
atggaggtgaatgcaggaggtgtgattgcctatatcagttcttccagctcagcctcaagccatgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagcccaagagaggagaacggattcgcaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtttgtccaatgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaa

SEQ ID NO: 192 - DNA, 871 bp, Equus caballus
  Oligonucleotide Sequence
gactttatttgaggtaagaaggcagagcaggatcagagagttcgagaacaggcatggcattatctggcttgtatttttaaagggtgcctctggtagaattatctattttgttttcatgaagagtcctgtaattattgccacgttgcaggtgaagaatctgaggctcagagaggttgagtcattgctcaggttggcacagctggtgagcggcagagctgggtttcctagttacctccgtctgactgcagaatccaaatcttcgtccaccatactgggcttgccctggtcccttcctaattcctttagctttgtaaaacatgtctaaatttggagtatccagagagttgtgactgtgtcgccttctatcactgttgacttcaaccccatctcttcctgatgcatcccctaggatgtgagagctcactcttatggctccacctgggtttctcatgtttggtgctaccatccttaacctttcaccaaggggctcaagatgtttcccatgatgatccagcctttccgttcttccctttgctggcaattatacgtgcttacctttctcggacaggacccactttccgggtgactgcatgcaaactctccctttctctttttagatgttaatagcagagttatcaagaacgaatgctctgaagagaacatggcctttagcttgaaagccaaaggggataagatgacgatttcatgctccacaattaaagaatctggatccacaggtacagacccactccggagaatcagggtgggtagttatggtacactcagtcaacaaacacttatcgatcacctcttaggtgccaagacctatgccaggtggtggggaaatcaatgatgggagaggcaaaaatgg

SEQ ID NO: 193 - DNA, 672 bp, Equus caballus
  Oligonucleotide Sequence
gttatggtacactcagccaccaacacttatcggatcccctttttaggggccaagacctatgccaggtggggggaaatcaatgatggaagaggcagaaatggcctcaggaaagtttcccacctgctaggaaaggcagacattgaaaaaataatcttgcagtaccggagtattgaaagcttacctatctaatacagcagccactggccacttttgtcattcagcacttgaaatgtggccaggttgtgaatttaaaatacctaccagatttcaaagacttggtccaaaaaaaaaaatggaggatgtaaaatagctcactcataattttttctattgatcaagtgttgaaacgatactattttgcatgtattgaattaatatattattaaaatgaattttacctgttttctactctaaaatgtggctattagaaaatttaaaattgcgtatgtggctcatagtatatttctagcagatagtgctgatctgtatcaggggctgggaaacttttcctgtagagggccgctttgtaaatattttaggctttgagggcaacacaatttctgtcgcaaccattcgaccctgccgtcatcatgcaaaagcattcatcagcagcgtgtaaatgaatgggtgtgtctgtgttgcaatagagcttttatttaaaaaaaaaaaaaa

SEQ ID NO: 194 - DNA, 1207 bp, Equus caballus
  Oligonucleotide Sequence
ttcgcataccacttgtggacattataaattgctgatttccagtctccattcccagagattctgattctgtaggggtgacctggggcccaggatcaaatctttctaaccagttccacaggtgattctgatgtacgtatacagagtttgagaactatcactttagagcacgggttggaaaattacaacccacagatcaaatccggcctgctgcttttttggtgtgataaagttttattggaatgcagctacacttatttgtttgcatattgtctatgtctgtttcagcactgcaacagcagagttgagtagttacagcagacaccatacggccataaagctgaagatatttactatctggacctttacagaaaaagtttgcaaactcttgctctaaagctaaatgaacatttctccttaaataatttaaactctgttgcaatcctgatcattcctgccaaacacaattgtagatagaataactgttttttcagaatttagtctgagaatgttagttcttgtatagtccacactttctctaggacctttggcaaatcaaagaatgctgtgactcctgagtggtcaatagaagatatacatttccttggccttaccacaagtgattgaaagtgaagcatatggttctatagtctgcgtatctcataatagtccttagtaatctcatgcattaggaggcaatcatcaagtagagactctttcatccataagcccccaaaccaaactacttacctgattgtcaagaagaaaagcattgctgtatctatttttgaagagaggcattagtggctttggctaaagtttaacaaagctaaccacatcccctcccttcagccagccagccatctgattcccctaaatgcgtagaaataaagatgtagtgctgcaaatgtattttgactttttcaagttatgctgtttcctctattcttggataaatcatagtaggttaataatacagaaatgagattgcatatttctctttagtagaaattagcaaaattagctttttttgctacaacttaagacacttgatgtattcctctgtgttttatgttactgtaaactcaacatacggtgagttttgtggtatttgacctgttaggcaaaatcactattttcactttgactgacatttataatgttctgttcatgaaataaaattcttctgtctaaaaaaaaaaaaaaaaaa

SEQ ID NO: 195 - DNA, 4262 bp, Homo sapiens
cgaagaggatccggagcagctgctgccagcccgcgggcactgaagtcctcccggctgccgctcgagtagccacgggcgcgatcgggaccagaagtctcctcctccatgatcactttggaagccgggggggaagactttgccctgccctgagagctggtctgcgtttcccaggcgcggcggcggcggagcagcagctgcagcagccgagtccaaataggagcggccacagccaggggcgtgtgcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacctcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgttatggagatttccatacttttaaagacagttttaatgttgaatttggtattttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcctattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaacttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttattcaatttaaaaaaaaaaaaaaaaaa

SEQ ID NO: 196 - DNA, 1785 bp, Homo sapiens
  exon (1)..(1785)
atggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaa

SEQ ID NO: 197 - DNA, 1456 bp, Homo sapiens
gacatgacacaagtggcacatcccggacatggggtcccagcattccgcctctgctcgcccctcttcctgcaggcgaaagaaagatgacagggaggattttctggctgaacgggagcaggaagaagccatcgctcagtttccgtatgtggagttcaccggtcgagatagcatcacctgtctcacgtgccaagggaccggctacattccaacagagcaagtaaatgaattggtggctttgatcccacacagtgatcagaggttgcgccctcagagaactaagcaatatgtactcctgtctgtcttgctgtgtctcctggcatctgggttggtggttttcttcctctttccacattcagtccttgtggatgacgatggcatcaaagtggtgaaagtcacgtttaataagcaggactccctggtgatcctcgccatcacggccaccctgaaaatcaggaactccaacttctactctgtggccgtgaccagcctgtccacccaggttcagtacatgaacaccgtggttgggtcatatgtgacagcaaatgtctcccttattccacctcggagcgagcacctggtgaattttactgtgaaggctgagatgggaggaccgtattcctatgtgtacttcttctgcacattgccggatatcctgattcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctaccacttgggaggaaaactcctctctgtagcaccatttctgtttctgagaaccagcagaatcactgcccagtgcctggccatatgcccagcaaattaataggcactccaagaaggtttgaagaatgtaattcagatcttttcagctgttcttgggccgttataaattgaaatcatactgtggttctaggttatcagaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggcttttttttttttttagagagttacacttgtttttaccaagaacctttatgggctttgatttacccttcatccattggctggaacatggattggggatttggtagaaaaataaaccctgcttttgattcaaaaaaaaaaaaaaaaaaa

SEQ ID NO: 198 - DNA, 750 bp, Homo sapiens
  exon (1)..(750)
atggggtcccagcattccgcctctgctcgcccctcttcctgcaggcgaaagaaagatgacagggaggattttctggctgaacgggagcaggaagaagccatcgctcagtttccgtatgtggagttcaccggtcgagatagcatcacctgtctcacgtgccaagggaccggctacattccaacagagcaagtaaatgaattggtggctttgatcccacacagtgatcagaggttgcgccctcagagaactaagcaatatgtactcctgtctgtcttgctgtgtctcctggcatctgggttggtggttttcttcctctttccacattcagtccttgtggatgacgatggcatcaaagtggtgaaagtcacgtttaataagcaggactccctggtgatcctcgccatcacggccaccctgaaaatcaggaactccaacttctactctgtggccgtgaccagcctgtccacccaggttcagtacatgaacaccgtggttgggtcatatgtgacagcaaatgtctcccttattccacctcggagcgagcacctggtgaattttactgtgaaggctgagatgggaggaccgtattcctatgtgtacttcttctgcacattgccggatatcctgattcacaacatagtgatcttcatgcgaacttcagtgaagatttcatacattggcctcatgacccagagctccttggagacacatcactatgtggattgtggaggaaattccacagctatttaa

SEQ ID NO: 199 - DNA, 2516 bp, Homo sapiens
cccacgcgtccgcccacgcgtccgcccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccgacgtgcaaagccaaggcagcgaccccggggcctctactggagatggaagcttgttgaaaacccagactgtgtccagggcttgcccagtcgaccccaaaggagaattgacaccaacttcaccctgaggtcactgctagagacgctgatccacaaagacaatcactgccaaccccccttcatctactgcaagagccaagttccaaaataaagcgtaaaggattttttagaagaaaagtaaaaagcacatgagaatgctggcaggccctgggtcagctgagcagctttccccctcagctccgccgtgcacttcccagagcatctcgcgtccatacctgaacccttgggcgaggacagtaacttggctgcatttgcctgtcatgcgcaactggagccagcaaccagcacatccatcagcaccccagtggaggagttcatggaagagttccctctttgtttctgcttcatttttctttcttttcttttctcctaaagcttttctttaacagtgcaaaaggatcgtttttttttgcttttttaaacttgaatttttttaatttacactttttagttttaactttctctgttgtatattttgctagctatgagctttgaagtaaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttccttccttcttgccccttgttgtaaaaagcccagcacttgaattgttcttactttaaatgttctgtatttgtatctgtttttattaaccgattagtgggattttatgccagttgttaaaatgagcaatgatgtacccattttttttaaatagcaaggcacagccttcgccccaaactgtcatctaacgtttgtcattccagtttgagttaatgtgctgagcattttttaaaagaagctttgtaataaaacatttttaaaaattgtcaaaaaaaaaaaaaaaaaa

SEQ ID NO: 200 - DNA, 1200 bp, Homo sapiens
  exon (1)..(1200)
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctga

SEQ ID NO: 201 - DNA, 1680 bp, Homo sapiens
gtgaggccttggacctgtggcctttgggcttgggtgtctcctgtccgctctgccagtgagtcctcagctctccgtacgtggcccgtcgcccgcggcaagacggagggaaggcgctagttcagtttagctagcaatgcccttcttgcgcgaggactgctggctggtggcgaggcccaggagcctgtttgggtgttaacagttaaaacagtaaagtttgcgcgggcttctgtggttttcagtcttttccccacttcacgtgatctcatttcattgagcaacattaaccaccatttaagatacgtgaaacctgcgaagtggaaaggtgcacgcaaagttaatttacaccccccgcgagatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 202 - DNA, 702 bp, Homo sapiens
  exon (1)..(702)
atgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatag

SEQ ID NO: 203 - DNA, 6506 bp, Homo sapiens
attgctaagccatccttcagacagagagggagcggctgcaagaggtaatgagagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcagatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacacccttttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggatgatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgaatttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcacagaacacccacttaagccgtcagaaattcataggtttcaaggttgcattggatgacgatgggactgctgaaggttgtctcttctgggatgatgggcaaagcattgatacctatgaaaaaggactctattatctggccaacttttctgccagccagaatacgatgcagagtcatgtaattttcaaccaatacatcgttgacacaaaccctttgaaactgggctacattgagatctggggagtgggcagtgctcctgtttccaatgtcagtgtctctctgagcagcacagttataacacccgccttcacctacaaccctacaacacaggtgttaaacatcgatgtgaccagcagagacatcagcctacataatttcatctcattgacatggagcagcactctgtgaatttttagagcaagatcctaattatgaaaggctttgaaactccttgtacatcatacccataaaattactgtgtgttgctaattggttcaagcccaatatggttaaaatatttcattaattttgttgtatgttttttgtgtgaaccctaaaggttaaaccttagccctgtaatataggcagtagggaagtgtgaaaaatctatggggtaccttaatgtctctgtgtgatcagtatggtactgatcactcatcatacaacatttgttgaagatgctctgggcccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggtgaaaggaagagccaactcacctgaagaagagggtcttgagaaatccttagcataaagggctactggtgagattgagatctgagcaggcaaagctcaaaagagagtttggaggttaaaaataatttatttttgcagtggtgtgctttgaaatttgtcagtcttatttctaatgtatataaccacagttcccataaatgcatgaaatttatatgccagagaaaaataaaacaagtgaatttgcaagtgaaaaaaaaaaaaaaaaaaaaaaaaaaaaaa

SEQ ID NO: 204 - DNA, 5574 bp, Homo sapiens
  exon (1)..(5574)
atggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcttcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcagatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacacccttttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagtgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggatgatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgatggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgaatttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcacagaacacccacttaagccgtcagaaattcataggtttcaaggttgcattggatgacgatgggactgctgaaggttgtctcttctgggatgatgggcaaagcattgatacctatgaaaaaggactctattatctggccaacttttctgccagccagaatacgatgcagagtcatgtaattttcaaccaatacatcgttgacacaaaccctttgaaactgggctacattgagatctggggagtgggcagtgctcctgtttccaatgtcagtgtctctctgagcagcacagttataacacccgccttcacctacaaccctacaacacaggtgttaaacatcgatgtgaccagcagagacatcagcctacataatttcatctcattgacatggagcagcactctgtga

SEQ ID NO: 205 - DNA, 698 bp, Equus caballus
  Oligonucleotide Sequence
gggacgaagtttccatgacatcataagcagagatggcagaaacatcaaggattctggggattacttcttatcaagactcagagagtgtggtgaccacaaagtcccccttctgctaagggactggccctggatttatgacccctgtggagtggtagccactagctgtgaagaggtctcagcccaggccccttcagtactcttttctcctgtatagaaggcatcatttgtctttctttccccagaaccttccaagacctggccctgacttctgcatgataaactgctatcaggaaccctatatcagttaaaacacattatccctctccactctcttgggaagccggaatttgagactgggtgggggcttgggatatttttaatagagcttatcttcagctagtgggttagttatgattctaaaactttgggagcctgagagatttgttaaaaatatagacacttgggccccactctaggcatgcagtccccaggtgattctgaagcagcccctattcagagtctctggtttagaggaagaactgaggccacttagactattgagtccttcatgcctgttcctgtctaccataggtgggataagagtttgttcttagagtaagagtaatttaatgaacctcaagacagtttaatgagagtgggagtttcctagaccaggcttcccaaaggagaaaaggatt

SEQ ID NO: 206 - DNA, 654 bp, Equus caballus
  Oligonucleotide Sequence
ttttttttttttttgaaaagttaaactgtctttattcacaaccaacattatcatctacgtaggatgtctaacaggatgtaccaaaaaaagctaccagcattaataagtgagtttaggaagttttcagggtacaagatcaatgtactaaagtaactgtatttctatatattatcaatgaacaattggaaattgaaattttaaaaataccatatacaatagcatcaaaaaatatgaaatatttagggctaaatctgacagaagatgtgttcatggattggaacactcaatatcagtaagttgtctgttctccccaagttgatctataaatttgatgcaatcctgatcatgattccaggagaccttttgtagtaatgagaagtcaattcgtttgggagggcaaaggactgagaatagccaaactgctttctttaaaagttgtaacccagcctttccaatcctgagtatttatccaatagaaatgaaagcatacgctcacatgatgacttatacaccgaatgttcgtagcactttatttgtaataaccaaaacaggagacaacccaaaagactgtcaacaggtgaatggataaagcagcttgtggtatatccatacaatgaaatactaatgaacaataaaaaggaatgaactattgat

SEQ ID NO: 207 - DNA, 4417 bp, Homo sapiens
attgcggagctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagaggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaaggagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccgtgtccatagccataattccaccatacagatcattggcagtgtttaaaatgagggtaggtgacagggtggacagtgtttgatcatcatgtagaatatggctatgaatcaggaaagagattagaacatttaataatgtatgtacagctggtgcttagtttttttttaatctaaatttaattacattattggatatttgatgtttgcttactaaattacagtcatctttgacagctgaattgattggtgtttcatctcctgtcaccctttggctttctttacttaccaattcacaaaggtgtagacagcaggtagtaggtccctaggaaaatttattgatgaaacagcctctgcaagattttaaaagttttgttctttcatagattgatttagaaaaacaaatgattagttaaaaaaagaaaatatacatttgttggtaactaatgttattttttaaaacctggacctttctggaagggcagcctatgaaaacattagtcccagagaagggacaataaatactacctcactactacacctgcgatgactggttgttcaaacacaacagagtgtgtcagctgtatgttttataatacataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttattaattttcttcattttgaattgtgtgcactaccattgtcacatcagtttgatatcagtgttgaaaaattaccagttatatttgctgtttataatctatttgtagattaggattaaaatggatttaatccatttttaaagctgtgtgaatttttctaaacaggaacaactatttgcaatataggttttcatagtgattaaaccaattataacttttattattagcaattgagagcacatgttcatatagcaatgtaaaaatatattaatgagtatttggtaaattccaacaggcttttaccattagcataattttgtgttgtacaattaagttacaattacatctataattttggataacattcattggttaacaataaagtgacaaaagctcaaaaaaaaaaaaaaaaaagaaaaaaaaaaaaaaaa

SEQ ID NO: 208 - DNA, 1752 bp, Homo sapiens
  exon (1)..(1752)
atgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagaggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaaggagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtga

SEQ ID NO: 209 - DNA, 554 bp, Equus caballus
  Oligonucleotide Sequence
agtttctgctttttgtttttagaataaatcgtcagggaaatgaagagaggatgcttttgttttgggttatggtcaagaactgattaaataatttagtgtctctggcacacactaaaaccatatacttcagttgtgatcttggtgacatatctgttggcttaggttttattacatttattatcgcagatgttcggttgaccaagtagttcattactttctcttaatttttttaaattttaatttgggcttctaactgcagcgtttgagaactcagcatccttgttttctgcaaatactgattaaaataaaatgctgtaaaacgtgttgtaaaacattgtaattaccttcccatgtctttgttgtacttgtgcagaaatgttttcacattcctttgtccggagaaaaaatctttgctttcattttgattatgttgcttaccttgaaatcaataggttttgatattttctcttggaagattttatatctttttgggaatatgtaatatatgatctctaataaaagataaatctcaaaaaaaaaaaaaaaaaaactcg

SEQ ID NO: 210 - DNA, 808 bp, Equus caballus
  Oligonucleotide Sequence
gggaccaaggcagaggctgagctggggatgttccccagtacattcaggaaactcctgcacacagtcaacgtaccctccttcagcaaggcgccctccagcaggccccagcagaccagctacgaacccccgtcttgttccggaccaaagaccactttcccttgttgcagtgaaagaccttgggtgtgagtctgctagccaacactgcaagaggacgctgagattatctcgagtattaaatccattgaaaatcctactaatagacatccatgatgttggagagtatggaattttacagtttattttttgcacaccctatttctcactgtcttcattatttcacgtaggatgtatgattttctatgtcttccacttctaacctgaaagctgcttggtggggggactggagaagcaaaatggatctgtgcgctgtggcagaactgttatttttatggattttacagctcaactaacagtgttaccttttcaaaatttatatatactcctaaagccttgttattatttgatcctaatagtgattcagttttctatagcttacttttagggtagatggtaaattatttaacattatattaaactttccatatcatggatagtaaaccgaaggaaattatacaatttctgagaaaatgtattatttaaactaattctgaagttgtatttgaaaatatgacctcacaatcttaatttgtccatagcaaacatgtctatatatggttgcagcatttggtttataatttaaatattaataaaggttttaaattttgttggaaaaaaaaaaaaaaaaaaa

SEQ ID NO: 211 - DNA, 616 bp, Equus caballus
  Oligonucleotide Sequence
tttttttttttttttttttccaacaaaatttaaaacctttattaatatttaaattataaaccaaatgctgcaaccatatatagacatgtttgctatggacaaattaagattgtgaggtcatattttcaaatacaacttcagaattagtttaaataatacattttctcagaaattgtataatttccttcggtttactatccatgatatggaaagtttaatataatgttaaataatttaccatctaccctaaaagtaagctatagaaaactgaatcactattaggatcaaataataacaaggctttaggagtatatataaattttgaaaaggtaacactgttagttgagctgtaaaatccataaaaataacagttctgccacagcgcacagatccattttgcttctccagtccccccaccaagcagctttcaggttagaagtggaagacatagaaaatcatacatcctacgtgaaataatgaagacagtgagaaatagggtgtgcaaaaaataaactgtaaaattccatactctccaacatcatggatgtctattaagtagggattttcaatggatttaatactcgagataatctcagcgtcctcttgcagtggtggc

SEQ ID NO: 212 - DNA, 1485 bp, Homo sapiens
gcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaaa

SEQ ID NO: 213 - DNA, 1119 bp, Homo sapiens
  exon (1)..(1119)
atggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatga

SEQ ID NO: 214 - DNA, 500 bp, Equus caballus
  Oligonucleotide Sequence
gcacgaggcagccagcagctttggagcccccacaacctggacactcacatcgaagtctctgcctagccaccctctccctgagcccatctcagatgcccctcccccccaggctgccaggtggctggggtgaggtcaggtggcaggcccagaataggcccagtcatccactcccctccctctcaggattgcaggagtctgagctattcccggccacctctatctcccaccccaccttctccaccatagccaggggctgggccccgtaggtgaaacaagcgggtgaaacccctctggggcccagacatgcaaacctctggcaccactgggtcctggctgaacccctgggtggtgtgcagcttcccctctggtctcagtttcctttcctgaaaagcgaggagttggaggcaacgttctcctcctggcctgtggccctcagaggagaaggactggaaggaacttcagagaatcctcactcccctcattttacagatgaggaaact

SEQ ID NO: 215 - DNA, 562 bp, Equus caballus
  Oligonucleotide Sequence
cctttcctgaaaagcgaggagttggaggcaacgttctcctcctggcctgtggccctcagaggagaaggactggaaggaacttcagagaatcctcactcccctcattttacagatgaggaaactgaggcccagagtgggcagagacttggcatcattgtcatccagcaaataacagaagggaagttccttggggaagaaccaggagcagaggtctggggagaggtgggcaaggagggggtcagtctcccctagtccagaaaagggcctcacctgccaggggcctccagtctctggccctctgtcctgcgcattgctttccaaggagccttcttgaggtcactgcatttgatcttcatggcggcacctggaagagagacatgagcgtttgtgtttgctttaaaaaaagcatttttcattttaaaaaatcaaggtgtgctttgtagacactttggaaagttcaggagagtaatccagggtggagtctatgcagaaatgacccataatccagcaacgccaggcccctgagtggtggcttctatgtagctgtaatcgtactatacat

SEQ ID NO: 216 - DNA, 1324 bp, Homo sapiens
cggcacgagcgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaaaaaaaaaaaaaaaaaaa

SEQ ID NO: 217 - DNA, 342 bp, Homo sapiens
  exon (1)..(342)
atgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaa

SEQ ID NO: 218 - DNA, 462 bp, Homo sapiens
aaaacactctgtgtggctcctcggctttgacagagtgcaagacgatgacttgcaaaatgtcccagatggagcgcgacatagagaccatcatcaatgtcttccaccagtactctgtgcgactggggcacccggacaccctgaaccggaaggaattcaaacagctggttcaaaaagagctggcgaacttcctcaagagtaagaagaaggatgagaaagccataaatcatatcatggaggacctggataccaatgaagacaagcagctgagtttcgaggagttcatcatcctggtggccaggctgacgcatgcctcccatgagaagatgcacgagcatgaccaaggccacggccactgccatgggccaggccttggggagggcaccccctaagaccacagtggccaagatcacagtggccacggccacggccacagtcatggtggccacggccacagccacccat

SEQ ID NO: 219 - DNA, 345 bp, Homo sapiens
  exon (1)..(345)
atgacttgcaaaatgtcccagatggagcgcgacatagagaccatcatcaatgtcttccaccagtactctgtgcgactggggcacccggacaccctgaaccggaaggaattcaaacagctggttcaaaaagagctggcgaacttcctcaagagtaagaagaaggatgagaaagccataaatcatatcatggaggacctggataccaatgaagacaagcagctgagtttcgaggagttcatcatcctggtggccaggctgacgcatgcctcccatgagaagatgcacgagcatgaccaaggccacggccactgccatgggccaggccttggggagggcaccccctaa

SEQ ID NO: 220 - DNA, 1170 bp, Equus caballus
  Oligonucleotide Sequence
cacggctggagaccatgggaagcagtgccgggacaccttccctcattgcctttcagtgacttgggctgagtatggacccgaggaccccagtgcaggcagacactctccccaaacccaccatctgggctgagccaggctctgtgatccctcgggggaagcctgtggccatcaggtgtcaagggacactggagacccaagagtatcgtctgcataaagagcgaaatccagtgccttgggaccaaaagagccctctggagcccggggaaaaggccaatttctccatcccacacatgacagagaaatattcagggacatatcactgttactatctcggccccactggctggtcagagcacagtgaccccctcgagctggtggtgacaggattctacaccaaacccaccctctcagccctgccgagcccactggtgatctcaggagggaatgtgaccctccagtgtggctcaaagcttggatttgccaggtttgttctcactaaggaaggagaaaacaagacctcctggaccctggattcacagcgacaacccaatgggcagttccaggccctgttccctgtgggccctgtgatccccttccacaagtggatgttcagctgctatggcttttacaggaactaccctcacgtgtggtcacatcctagtgaccccttggagctcctggtctcagcctcacaccctcaagattacacagtggagaatctcatccggatgagtgcagctggcttgatcctggtggtccttgggattctgctatttcaggctcaacacagccagaaaagaccccaagaggcagacaggaagtaaacacaagtgagaaaaatgcacagttcagagtagtagagccttgaaagtaaatcttgtgcacccaggaggttcctgaagagcatctgtggtgtatgatcagtgaactgtctgcaggtcattgtgaggtgtagtagttatcgttcatgtgcagggacaatgtccgctcctttctgccattaaactgagggacattccttcacaagcacttttgagttatcttggtgggtttgtaactttctctctttttgtgaaatcagcatgtatcccaaaggacagatttgggtccacacttccttgcactttcatgctgtggtacaatttcatgtaatacatatatttttaaatt

SEQ ID NO: 221 - DNA, 468 bp, Equus caballus
  Oligonucleotide Sequence
  exon (1)..(468)
atggacccgaggaccccagtgcaggcaggattctacaccaaacccaccctctcagccctgccgagcccactggtgatctcaggagggaatgtgaccctccagtgtggctcaaagcttggatttgccaggtttgttctcactaaggaaggagaaaacaagacctcctggaccctggattcacagcgacaacccaatgggcagttccaggccctgttccctgtgggccctgtgatccccttccacaagtggatgttcagctgctatggcttttacaggaactaccctcacgtgtggtcacatcctagtgaccccttggagctcctggtctcagcctcacaccctcaagattacacagtggagaatctcatccggatgagtgcagctggcttgatcctggtggtccttgggattctgctatttcaggctcaacacagccagaaaagaccccaagaggcagacaggaagtaa

SEQ ID NO: 222 - DNA, 450 bp, Equus caballus
  Oligonucleotide Sequence
gcacgagggaagagggtctccttccaccccaaggaattttttttaatcagaagaccttgaaaagggggatataactttgaacaatttaatttcttggccgtgtttagtaacagttcctatgcatggtttttaacgtataaatttgctttcttccctctcccacctgattctgcctctttaatgaatatttttactggggttgaaactcaatgccttatgtgctcactcagtttcccttctgcagcttgttttttctcactatctgtatgtgttcagattgtgtcaaatgctggcaaaacctctaagactgtcaagaaaggcttgaaagttgatttgtcctagtgcaaattcaagataaatgtcttaatgttttttggctatgtagtacataggaacagaaaataacttaaataaagtcatttttgtaatttaaaaaaaaaaaaaaaaaaa

SEQ ID NO: 223 - DNA, 408 bp, Equus caballus
  Oligonucleotide Sequence
gcacgagggaagagggtctccttccaccccaaggaattttttttaatcagaagaccttgaaaagggggatataactttgaacaatttaatttcttggccgtgtttagtaacagttcctatgcatggtttttaacgtataaatttgctttcttccctctcccacctgattctgcctctttaatgaatatttttactggggttgaaactcaatgccttatgtgctcactcagtttcccttctgcagcttgttttttctcactatctgtatgtgttcagattgtgtcaaatgctggcaaaacctctaagactgtcaagaaaggcttgaaagttgatttgtcctagtgcaaattcaagataaatgtcttaatgttttttggctatgtagtacataggaacagaaaataactt

SEQ ID NO: 224 - DNA, 362 bp, Equus caballus
  Oligonucleotide Sequence
gcacgagccgagccctgagcaaaaccctccccatccgctgtatttatctctatttaatatttatgctctgtgtataaggatgaattagagttgtcattttctcttcactggatgtttatttataaagatttgacctgttcatgcgtctgtggagcagccctccgtctcccggctatatagtaatcttaggtagagtgttgccttgtgggttaccgtttgctctgagacttctcggatggacccaccctcctccagccctggctgccagcgccgcggggccgcgtgctgggcctgccggggcctggcgccgagccgtgtccaataaagttctcggatgtgactggaaaaaaaaaaaaaaaaaa

SEQ ID NO: 225 - DNA, 742 bp, Equus caballus
aggcagagcacccaccatggccccctttgcacccctggtctccggcattctgttgttgctgtggctcacagcccccagcagggcctgtacgtgtgtcccaccccacccgcagacggccttctgcagctctgagttcgtcatcagggccaagttcgtggggacctcagaagtcaaccagaccaccttacagcggcgttatgagatcaagatgaccaagatgttcaaagggttcagcgccttgggggatgcccctgacacctggtttgtctacacccccgctatggagagcctctgcggatacttccacaggtcggagaaccgcagcgaggagtttctcatcgccggacaactattggacgagaagctgtacatcaccacctgcagtttcgtggctccctggaacagtctgagctccgctcagcgccagggcttcaccaagacctacgccgccggctgtggggaatgctcagtgtttccctgttcatccatcccctgcaaactgcagagtgacactgattgcttgtggacggaccagctcctcacaggctctgacaagggcttccagagccgctacctcgcctgcctgccccgggagccagggctgtgcacctggcagtcccttcggccccggacggcctgaatcctgtctccagcagaagctgaagcttgcacagtgttcaccctctttcccattcctatctttctttctccaagacagtgaaataaagaactaccacccaaa

SEQ ID NO: 226 - DNA, 624 bp, Equus caballus
  exon (1)..(624)
atggccccctttgcacccctggtctccggcattctgttgttgctgtggctcacagcccccagcagggcctgtacgtgtgtcccaccccacccgcagacggccttctgcagctctgagttcgtcatcagggccaagttcgtggggacctcagaagtcaaccagaccaccttacagcggcgttatgagatcaagatgaccaagatgttcaaagggttcagcgccttgggggatgcccctgacacctggtttgtctacacccccgctatggagagcctctgcggatacttccacaggtcggagaaccgcagcgaggagtttctcatcgccggacaactattggacgagaagctgtacatcaccacctgcagtttcgtggctccctggaacagtctgagctccgctcagcgccagggcttcaccaagacctacgccgccggctgtggggaatgctcagtgtttccctgttcatccatcccctgcaaactgcagagtgacactgattgcttgtggacggaccagctcctcacaggctctgacaagggcttccagagccgctacctcgcctgcctgccccgggagccagggctgtgcacctggcagtcccttcggccccggacggcctga

SEQ ID NO: 227 - DNA, 7739 bp, Homo sapiens
atggcatcgtggcgtcgcgacggcgtgtgcgtgtcgcgcttcctagtgccgtttatagggtcccggcacttccgctgtcggacgcggctgcctttccgccggggcatcgcgctgttggaaagcggctgcgtagacaacgtcctgcaagtcgttccgcgcgcgcccgcacccctgcgggtgtcctcactggcccggacggtcctcctgagcggagcgcccatttcctccctcccttccctgccccccgtcgccccggacgggccagcgcgagtgggaaatgaatcagcaggacgcgcccctccgtgggctccgcgcccccggcccgcgctcccctacccgccctcctccggggagcacatcctggagggctgttcgccggtttcgggggtggatgtggacaaaggcgcgggcggacggccggcctccggcgagggtgtgtgtggcggggctggctccgacgggcgagcggccgcggcgctcccgggtcgctgtggcgtctggcccgggcgagctccactggccgcccggggtttaaatgtcgttttctttgcgcctcctcagtctccaagcggcgcagaggagaggtggcggcggaccggactccgtctccggagggacatctcgcccgtaggacgcttactaattaaagggcgcgagcctgaggaggagctgctagcgcttcccttttctctgaagctgcctccagacacccctgtgcgggccgcggcgcagcccttgtgccccgccgcccgagttttgtttgcgctgtgtggtcaggtcgtggtgccccgggcgagccgcggtcggcagttgcggatttgccgctcgcagccaaaggggcgagcgggctgcaggagcgcgaggcagagggctcggcggccgctcccgcgtccccgcggcgcggcagcccggcacgacccagcactttgttctcattttcaggaaactcttctgtttgctgatgaggaaaggttatctttccaggcagcatccaggaatggtcttttgaatgtcttcatgccttcttgtgacctcattcctgctgccatcgtacttatccctgctcagattaactgcctgcgtgttcaactttattccatagttggatctacctgtctgctggagatcttcattggttctgctgctttggagccaccacagatgatgatggagcctacagttatctgttgctgctgttggagggtaagtctctccggcccggtttccctcggtgtgctactgtgcgcgcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaaggaaaagaaaggctccaaggctttggctgaatttgaagaaaaaatgaatgagaactggaagaaagaactggaaaaacacagagagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacagagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggagctgcttatcatgggcacagctgacaaaaccagaagagcctttctatggtgccatgaatgctgtcttctcctccatggtctggaagcagccatggccaaacttggaggtggtgtcaatgaacttaaggtcaatcttctccagaggccgccgtttggttggcactggcaaggacttgtgaaggccattgcccttggtcaacctgatgacgtcgatcatcttgtcctgctcaaacacttggttcacaggtacctgctgctcaagcctctcgtgggcccagtccagcttcttggccatggtgcctccctttacctggatctccatcaggtgggccttcctctggtgcagaggaagcaggcacatctgggtgtaggcaatgatgcagatgacttggcggtacttcttcatgctgctgaagtccttctccagctgcttcttgccatcctcatcctgacatttcttgcagtacttggtaaaggccttcttcttagatttatgccggtttttatagaaatgtctcttgcatgcatcgctgatgtgctcagcgaagacagtattgaaggtctggaggcctcgaggggtttccacgaagcccacaatggccacaaccaccatgggtggtatctccacaatggtcacagcctctatcacttccttcttgttcaccttggatcctggcctgtcgacttcccgcatgatgttggtcatgccagccttgtatcccaggaaggctgtgaggtggaccagcttggaagggtcatccttaggaaagctcttcaccttcccatgatgcttcctgctgcgctgctgaggcaggaagccgagggacccatgtctgggagcggagaaccttctctgagggctttcgaagcttcccaccagtgggtttgtctgaactgtttaggaatgcggccgcggtcgccagctgacgtcagcgccgccggttcagccgcaggccagagtcagagactgacagcgcgaggggcggggttgggagtcaggatggggcgaggcctgcgtgtgactgatggcgcgggggcggggcggcgtttccacttgagcggcacagtgacagaacctgcaatacaatcggagccagaaactgtttgcaacgtggccatcagctttgatcgttgcaagattacctcagtgacctgcagctgtggaaacaaggacatattttattgtgcccatgttgtggcactgtctttataccgcatccgcaagccagatcaggtcaaactgcatcttcctatttcagagactctctttcaaatgaatagagaccaactgcaaaagtttgtacagtatttgatcacagtgcaccacacagaagttttgccaactgctcaaaaattagcagatgaaattctttcccaaaattcagaaatcaaccaagttcatggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaactgagagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagtt

SEQ ID NO: 228 - DNA, 5886 bp, Homo sapiens
  exon (1)..(5886)
atggcatcgtggcgtcgcgacggcgtgtgcgtgtcgcgcttcctagtgccgtttatagggtcccggcacttccgctgtcggacgcggctgcctttccgccggggcatcgcgctgttggaaagcggctgcgtagacaacgtcctgcaagtcgttccgcgcgcgcccgcacccctgcgggtgtcctcactggcccggacggtcctcctgagcggagcgcccatttcctccctcccttccctgccccccgtcgccccggacgggccagcgcgagtgggaaatgaatcagcaggacgcgcccctccgtgggctccgcgcccccggcccgcgctcccctacccgccctcctccggggagcacatcctggagggctgttcgccggtttcgggggtggatgtggacaaaggcgcgggcggacggccggcctccggcgagggtgtgtgtggcggggctggctccgacgggcgagcggccgcggcgctcccgggtcgctgtggcgtctggcccgggcgagctccactggccgcccggggtttaaatgtcgttttctttgcgcctcctcagtctccaagcggcgcagaggagaggtggcggcggaccggactccgtctccggagggacatctcgcccgtaggacgcttactaattaaagggcgcgagcctgaggaggagctgctagcgcttcccttttctctgaagctgcctccagacacccctgtgcgggccgcggcgcagcccttgtgccccgccgcccgagttttgtttgcgctgtgtggtcaggtcgtggtgccccgggcgagccgcggtcggcagttgcggatttgccgctcgcagccaaaggggcgagcgggctgcaggagcgcgaggcagagggctcggcggccgctcccgcgtccccgcggcgcggcagcccggcacgacccagcactttgttctcattttcaggaaactcttctgtttgctgatgaggaaaggttatctttccaggcagcatccaggaatggtcttttgaatgtcttcatgccttcttgtgacctcattcctgctgccatcgtacttatccctgctcagattaactgcctgcgtgttcaactttattccatagttggatctacctgtctgctggagatcttcattggttctgctgctttggagccaccacagatgatgatggagcctacagttatctgttgctgctgttggagggtaagtctctccggcccggtttccctcggtgtgctactgtgcgcgcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaaggaaaagaaaggctccaaggctttggctgaatttgaagaaaaaatgaatgagaactggaagaaagaactggaaaaacacagagagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacagagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggagctgcttatcatgggcacagctgacaaaaccagaagagcctttctatggtgccatgaatgctgtcttctcctccatggtctggaagcagccatggccaaacttggaggtggtgtcaatgaacttaaggtcaatcttctccagaggccgccgtttggttggcactggcaaggacttgtgaaggccattgcccttggtcaacctgatgacgtcgatcatcttgtcctgctcaaacacttggttcacaggtacctgctgctcaagcctctcgtgggcccagtccagcttcttggccatggtgcctccctttacctggatctccatcaggtgggccttcctctggtgcagaggaagcaggcacatctgggtgtaggcaatgatgcagatgacttggcggtacttcttcatgctgctgaagtccttctccagctgcttcttgccatcctcatcctgacatttcttgcagtacttggtaaaggccttcttcttagatttatgccggtttttatagaaatgtctcttgcatgcatcgctgatgtgctcagcgaagacagtattgaaggtctggaggcctcgaggggtttccacgaagcccacaatggccacaaccaccatgggtggtatctccacaatggtcacagcctctatcacttccttcttgttcaccttggatcctggcctgtcgacttcccgcatgatgttggtcatgccagccttgtatcccaggaaggctgtgaggtggaccagcttggaagggtcatccttaggaaagctcttcaccttcccatgatgcttcctgctgcgctgctgaggcaggaagccgagggacccatgtctgggagcggagaaccttctctgagggctttcgaagcttcccaccagtgggtttgtctgaactgtttaggaatgcggccgcggtcgccagctgacgtcagcgccgccggttcagccgcaggccagagtcagagactgacagcgcgaggggcggggttgggagtcaggatggggcgaggcctgcgtgtgactgatggcgcgggggcggggcggcgtttccacttgagcggcacagtgacagaacctgcaatacaatcggagccagaaactgtttgcaacgtggccatcagctttgatcgttgcaagattacctcagtgacctgcagctgtggaaacaaggacatattttattgtgcccatgttgtggcactgtctttataccgcatccgcaagccagatcaggtcaaactgcatcttcctatttcagagactctctttcaaatgaatagagaccaactgcaaaagtttgtacagtatttgatcacagtgcaccacacagaagttttgccaactgctcaaaaattagcagatgaaattctttcccaaaattcagaaatcaaccaagttcatggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttga

SEQ ID NO: 229 - DNA, 3555 bp, Equus caballus
gggcgctgccgagcctggctgccctggatcccgcacttcccgctcgggcgctggacggcgaatgggccaggggcgcgcaggtgcagtagggtctcccaatggggtgcctttgccccgggctcacgctccctgtgagctgcctgatcctggtgtgggcggcaggctctgggagcgttaaggtcctgcgtctcaccgcctgcttctccgactacatcagcgcctccacctgtgagtggaagatggaccgtcccaccaactgcagtgcccagctccgtctgtcctaccagctgaacgacgagttctctgacaacctcacgtgtatccccgagaacagagaagatgaagtgtgcgtgtgccgtatgctgatggacaacatcgtcagcgaggacgtctatgagctggacctgtgggctgggaaccaactgctgtggaacagctccttcaagcccagccggcacgtgaaacccagggcccctcaaaacctcacggttcacgccatctcccacacgtggctgctgacgtggagcaacccgtaccctttgaagaatcacctgtggtctgagcttacctacctggtcaacatctccaaggaggacgaccccacggacttcaaaatctacaacgtgacctacatggaccccaccctccgcgtcacagccagcaccctgaagtccagggctacgtacagcgcacgggtgaaggccagggctcagaactacaacagcacctggagtgagtggagccccagcaccacgtggcataactactacgagcagcccttggagcagcgcctcccgcttggtgtcagcatctcctgcgttgtcatcctggccatctgcctgtcctgctatttcagcatcatcaagattaagaaagaatggtgggaccagattcccaacccagcgcacagccccctcgtggctatcgtcctccaggattctcaggtgtcactgtgggggaagcagtcccgaggccaggagccagccaagtgcccacgctggaagacttgtcttaccaagctcctgccctgtttactggagcatggcctgcaaaaggaggaggattcctccaagactgtcagaaatgggcctttccagagtcctggaaaatcagcatggcacactgtggaggtcaaccacacgatcctccggccagagatcatcagcgtggtgccgtgtgtggagctgtgtgaggcccaggtggagagcgaggaggaggaagtggaggaagatagagggagcttctgcccgtcgcctgagagcagcgggagcggcttccaggaaggcagggagggcgtcgcggcccggctgacagagagcctgttcctgggcctcctcggggctgagaatggggccttgggggagtcatgccttcttccccctttaggaagtgctcacatgccctgggccaggatctcaagtgcagggccccaggaggcagcgtcccagggtgaggagcagcctctcaacccagagtcaaatcctctggccactctgacccagagcccaggcagcctggctttcacagaggcgcctgctgtggttgcagacaaccccgcctaccgcagcttcagcaactccctgagccagccccgaggtcctggagagcttgactcagacccacagctggccgaacacctgggccaagtggaccccagcatcccctccgccccccagccctctgaaccacccactgcactccagcctgaaccagaaacctgggagcagatgctccgccagagtgtcctccagcagggggcagccccagcccccgcctcggcccccactggcggctaccgggagtttgcgcaggtggtgaagcagggtggcggggcggcgggctccggcccttctggggaggctgggtacaaggccttctccagcctgctcgctggcagtgccgtctgcccagggcaatctggggttgaggccagcagtggggaggggggctacaggccctatgagagccccgaccctggagcccctgccccggtccccgtccccctgttcacctttggactggatgtggagccacctcacagccctcagaactccctcctgccaggcggctccccagagctccctggcccagagccgacggtgaagggagaggacccacggaagcccctgctttccgcacagcaggccacagactccctcagggacgacctgggcagcggcattgtctactcggccctcacctgccacctttgtggccacctgaagcagtgtcatggccaggaggagcatggcgaggcccacactgtggccagcccctgctgtggctgctgttgtggggacaggtcctcccccccagtgagccccgtgagggccctggaccccccgccaggtggggttcccctggaggcgggcctctctcttgcctccctgggatccttggggctctctgaggagcgcaaaccctccctcttcttccagcctgctcccggcaatgctcagagctcgagccagacccctctcacggtggccatgctctccacagggcccacatgcacgagcgcttcctaggggcgtgccctctggttgctgcggtccacaggtgaggaccgggtcttcgaaatgcctccccccacattttggggcagccaggctggcagacttctgaaagactcagagaaccctggtaggaagctgtgaggttgtccaacctggggctacagagactggacccccttgctcccagccgtggcccaagctccccccatcccacgggagtggagcctgcagggcagccatgcccacggcaggcacctgcgggcatcgggaggtccctgggcagctgagcttgtgaacgagccgttggccgcttcgttggtgcacagcttctccagcatgctgtccctgtcacgcctgcccaaggcttgttttgtccacctaatctctctgttacccgagtctgacccagtcctgggttagctgccgccatatcactggattggatgctgagcctagaaactgatcaagctcatgggggaatgacttaggaggccccaggaaattcaagggaagtcggggtccaggaggataggatttgcctagagaggcccgttccttcaacagagcttcatctagctggcaccagaggcaggattgcacctgtggtgggtgcttagccaagtcggggtcacagagaaggacatgagaaattgtgattagccggtagtgacagtttgctgtcaggtccccccacaactgtaggcctgggcctcctcttaggcatgggatccccagagtggacctgcccagctacccagggccagtttgtgcacccatggagagcgttgctggcagccatagagaccagagggagtgggtcacagcccatgacccagccgaatggggcattccagacagctgacccggcacgttttgcctgcacatggctcagaccttgggtcgagtaacgcttgtttgtgtgtatctcaaagatatattttatctcactggtatttgtgtttgctgaggacggtggaatgggggggtctggagtcttgtatgaataaagattctttctctcaaaaaaaaaaaaaaaaaa

SEQ ID NO: 230 - DNA, 2430 bp, Equus caballus
  exon (1)..(2430)
atggggtgcctttgccccgggctcacgctccctgtgagctgcctgatcctggtgtgggcggcaggctctgggagcgttaaggtcctgcgtctcaccgcctgcttctccgactacatcagcgcctccacctgtgagtggaagatggaccgtcccaccaactgcagtgcccagctccgtctgtcctaccagctgaacgacgagttctctgacaacctcacgtgtatccccgagaacagagaagatgaagtgtgcgtgtgccgtatgctgatggacaacatcgtcagcgaggacgtctatgagctggacctgtgggctgggaaccaactgctgtggaacagctccttcaagcccagccggcacgtgaaacccagggcccctcaaaacctcacggttcacgccatctcccacacgtggctgctgacgtggagcaacccgtaccctttgaagaatcacctgtggtctgagcttacctacctggtcaacatctccaaggaggacgaccccacggacttcaaaatctacaacgtgacctacatggaccccaccctccgcgtcacagccagcaccctgaagtccagggctacgtacagcgcacgggtgaaggccagggctcagaactacaacagcacctggagtgagtggagccccagcaccacgtggcataactactacgagcagcccttggagcagcgcctcccgcttggtgtcagcatctcctgcgttgtcatcctggccatctgcctgtcctgctatttcagcatcatcaagattaagaaagaatggtgggaccagattcccaacccagcgcacagccccctcgtggctatcgtcctccaggattctcaggtgtcactgtgggggaagcagtcccgaggccaggagccagccaagtgcccacgctggaagacttgtcttaccaagctcctgccctgtttactggagcatggcctgcaaaaggaggaggattcctccaagactgtcagaaatgggcctttccagagtcctggaaaatcagcatggcacactgtggaggtcaaccacacgatcctccggccagagatcatcagcgtggtgccgtgtgtggagctgtgtgaggcccaggtggagagcgaggaggaggaagtggaggaagatagagggagcttctgcccgtcgcctgagagcagcgggagcggcttccaggaaggcagggagggcgtcgcggcccggctgacagagagcctgttcctgggcctcctcggggctgagaatggggccttgggggagtcatgccttcttccccctttaggaagtgctcacatgccctgggccaggatctcaagtgcagggccccaggaggcagcgtcccagggtgaggagcagcctctcaacccagagtcaaatcctctggccactctgacccagagcccaggcagcctggctttcacagaggcgcctgctgtggttgcagacaaccccgcctaccgcagcttcagcaactccctgagccagccccgaggtcctggagagcttgactcagacccacagctggccgaacacctgggccaagtggaccccagcatcccctccgccccccagccctctgaaccacccactgcactccagcctgaaccagaaacctgggagcagatgctccgccagagtgtcctccagcagggggcagccccagcccccgcctcggcccccactggcggctaccgggagtttgcgcaggtggtgaagcagggtggcggggcggcgggctccggcccttctggggaggctgggtacaaggccttctccagcctgctcgctggcagtgccgtctgcccagggcaatctggggttgaggccagcagtggggaggggggctacaggccctatgagagccccgaccctggagcccctgccccggtccccgtccccctgttcacctttggactggatgtggagccacctcacagccctcagaactccctcctgccaggcggctccccagagctccctggcccagagccgacggtgaagggagaggacccacggaagcccctgctttccgcacagcaggccacagactccctcagggacgacctgggcagcggcattgtctactcggccctcacctgccacctttgtggccacctgaagcagtgtcatggccaggaggagcatggcgaggcccacactgtggccagcccctgctgtggctgctgttgtggggacaggtcctcccccccagtgagccccgtgagggccctggaccccccgccaggtggggttcccctggaggcgggcctctctcttgcctccctgggatccttggggctctctgaggagcgcaaaccctccctcttcttccagcctgctcccggcaatgctcagagctcgagccagacccctctcacggtggccatgctctccacagggcccacatgcacgagcgcttcctag

SEQ ID NO: 231 - DNA, 1515 bp, Homo sapiens
  Oligonucleotide Sequence
ggggaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgactttgccaagtggcgctgtgtgctgaagattggggagcacactccctcatcccttgccatcatggaaaatgccaatgttctggcccgttatgccagcatctgccagcagaatggcattgtgcccatcgtggagcctgagatcctccctgatggggaccatgacttgaagcgctgtcagtatgtaaccgagaaggtgctggctgctgtttacaaggctctgagtgaccaccacatctacctggaaggcaccttgctgaagcccaatatggtaaccccaggccacgcctgcacccacaaatattctcatgaggagattgccatggcaactgtcacggcactgcgtcgcacggtgccccctgctgtcactgggatcaccttcctatctggaggccagagtgaggaggaggcatccatcaacctcaacgccatcaacaagtgccccctgctgaagccgtgggccctgaccttctcctatggccgagccctgcaggcctctgccctgaaggcctggggtgggaagaaggagaacctgaaggctgcccaggaggaatatgtcaagcgagccctggccaacagcctcgcctgccaaggaaaatacaccccaagtggtcacgctggggctgcagccagcgagtccctcttcatctctaaccatgcctactaagtggaggtattctaaggctgccccctcaacactccaggccctgcctcctcccactctcactcttgaagagggggcctcatccagggctttaggctgttctttcccattctccttgcctccctggtgacattggtctgtggtattgtctgtgtatgctaactccatcaccctttcgagcccactgccaaataaacagctatttaagggggaaaaaaaaaaaaaaaaaaaaaaaaaaaaaaaaaataaaaaaaaaaaaaaaaaaaaaaaaaaaaaa

SEQ ID NO: 232 - DNA, 1095 bp, Homo sapiens
  Oligonucleotide Sequence
  exon (1)..(1095)
atgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgactttgccaagtggcgctgtgtgctgaagattggggagcacactccctcatcccttgccatcatggaaaatgccaatgttctggcccgttatgccagcatctgccagcagaatggcattgtgcccatcgtggagcctgagatcctccctgatggggaccatgacttgaagcgctgtcagtatgtaaccgagaaggtgctggctgctgtttacaaggctctgagtgaccaccacatctacctggaaggcaccttgctgaagcccaatatggtaaccccaggccacgcctgcacccacaaatattctcatgaggagattgccatggcaactgtcacggcactgcgtcgcacggtgccccctgctgtcactgggatcaccttcctatctggaggccagagtgaggaggaggcatccatcaacctcaacgccatcaacaagtgccccctgctgaagccgtgggccctgaccttctcctatggccgagccctgcaggcctctgccctgaaggcctggggtgggaagaaggagaacctgaaggctgcccaggaggaatatgtcaagcgagccctggccaacagcctcgcctgccaaggaaaatacaccccaagtggtcacgctggggctgcagccagcgagtccctcttcatctctaaccatgcctactaa

SEQ ID NO: 233 - DNA, 2352 bp, Equus caballus
gtgccccgggtgctgacgctgagctgagccaagatgccgcgggagccgctagagagggcctggtttctggagactcggagttggctgtgaaaaaacccttggggagccccccactccccagcacggacgctcttggctcctgtgagaagggggctccggggcctgggcagggccggctgcgctgcagctatggaccgtgagctggcctggcccgcgtccttgctgaccctgcccgtctgcagccatgcccaccgtgggctccttggtgtacatcatggtggagctggccatcgctctgctggccatcctgggcaacatgctggtgtgctgggccgtgtggctgaacagcaacctgcagaacgtcaccaactactttgtggtgtcactggcagcggccgacatcgctgtgggggtccttgccatccccttcgccatcaccatcagcacagggttctgtgccgcctgccacggctgcctcttcatcgcctgcttcgtgctggtcctcacgcagagctccatcttcagcctcctggccatcgccattgaccgctacatcgccatccgcatcccactccgatacaatggcttggtgaccggcacgagggccaagggcgtcattgcagtctgctgggtgctgtcgttcgccatcggcctgacgcccatgctgggctggaacaactgccatcactggggggagggcgagaaccagtcgcagggctgcggcgagggccaggtggcctgcctctttgaggacgtggtccccatgaactacatggtgtactacaacttctttgcttgcgttctggtgcccctgctgctcatgctgggcgtctacttgcgcatcttcctggcggcgcggcgacagctgaagcagatggagacccagcctctgccgggggagcgggctcggtccacgctgcagaaggaggtccacgccgccaagtcgctggccatcatcgtggggctcttcgccctctgctggctgcccctgcacatcatcaactgcttcaccttcttctgccccgagtgcccgcacgccccgctctggctcatgtacccggccatcatcctctcccacttcaattccgtcgtgaaccccttcatctacgcctaccgcatccgcgagttccgccacaccttccacaagatcattcgcagtcacatcctgaggcggcaggagcccttcaaggcagggggcaccagtgcccgggccttggcagctcatggcagcgatgcagagcaggtcagcctccgcctcaacggccacccttctggggtgtgccccaatggcagcgccccccatcctgagcggcggcccaatggctatgccctggggctggtgagtcgggcgagtgcccgcgagtcccctggagacacaggcctcccagatgtggaactcctcagccacgagctccatggggcgagcccagagtcccctggcctcgaggggcccctggcccaagacggagcgggagtgtcctgacgactccccgtgtctgccccttcctaagggaagggggcctttctctttctggttggaggaaccgctcacgttgggagatgagtgcatgtgccgggagactcttctcgaggccagttcctgccgcggactgagagaagggagccccggctggagcagcatgaggtccagcaggaaggtctggcatccaaggaggtggacgcatcatgctgggagggcctgcacgaggccagggccgcggcaccagggcatcttggctgggtaggcccggtccccgactccagcagcacgtagaagtgccccctggtctctgcagagcagccgtggcggagcaggctggccggccctgaggctggggagtggccccgaaggccccccgccacacacgcaccaccctccccagactttcccaggttcgggagctgctgtgtccagaggtggcatttgactatttttgaccaggagaaaatgtaagcgcgaggaaatcctttttattgtattatcttccctccctggctgctgggtctgttgtcagtcctgctgctaacctggcaccaggagtggccagggagtcccaggcagccctctccggctgccgtgagctgccatgtgcttctcacccgtcagtcctgaggccacctcttggggtgacaaagctgggcttggtgacaggaagttgtaatggagcggtgccagagtgcgggctcagggagcaggttggggctggctggcatggggtgtgcctgggcggctcagagctgcccaagtggaggctctagctgactgcctttccttctgaggggaatgtttttttctgagatacaataaaaatgagccacattgtgttttaaaaaaaaaaaaaaaaaaaaaaa

SEQ ID NO: 234 - DNA, 1239 bp, Equus caballus
  exon (1)..(1239)
atgcccaccgtgggctccttggtgtacatcatggtggagctggccatcgctctgctggccatcctgggcaacatgctggtgtgctgggccgtgtggctgaacagcaacctgcagaacgtcaccaactactttgtggtgtcactggcagcggccgacatcgctgtgggggtccttgccatccccttcgccatcaccatcagcacagggttctgtgccgcctgccacggctgcctcttcatcgcctgcttcgtgctggtcctcacgcagagctccatcttcagcctcctggccatcgccattgaccgctacatcgccatccgcatcccactccgatacaatggcttggtgaccggcacgagggccaagggcgtcattgcagtctgctgggtgctgtcgttcgccatcggcctgacgcccatgctgggctggaacaactgccatcactggggggagggcgagaaccagtcgcagggctgcggcgagggccaggtggcctgcctctttgaggacgtggtccccatgaactacatggtgtactacaacttctttgcttgcgttctggtgcccctgctgctcatgctgggcgtctacttgcgcatcttcctggcggcgcggcgacagctgaagcagatggagacccagcctctgccgggggagcgggctcggtccacgctgcagaaggaggtccacgccgccaagtcgctggccatcatcgtggggctcttcgccctctgctggctgcccctgcacatcatcaactgcttcaccttcttctgccccgagtgcccgcacgccccgctctggctcatgtacccggccatcatcctctcccacttcaattccgtcgtgaaccccttcatctacgcctaccgcatccgcgagttccgccacaccttccacaagatcattcgcagtcacatcctgaggcggcaggagcccttcaaggcagggggcaccagtgcccgggccttggcagctcatggcagcgatgcagagcaggtcagcctccgcctcaacggccacccttctggggtgtgccccaatggcagcgccccccatcctgagcggcggcccaatggctatgccctggggctggtgagtcgggcgagtgcccgcgagtcccctggagacacaggcctcccagatgtggaactcctcagccacgagctccatggggcgagcccagagtcccctggcctcgaggggcccctggcccaagacggagcgggagtgtcctga

SEQ ID NO: 235 - DNA, 557 bp, Equus caballus
  Oligonucleotide Sequence
gtggtcctcctcatctctttcctcattttcctgatagtgggatgaggatggccttcctgtttcaccatcttctcaatctttctttaccgggttggggaagggctgtctacctgcggccctttcagtggtggtgtctccttgcttctctcttctcacccgtaggctaatacgcttggcactgatgggcactggggaatgcagagcagaccccggatgctatttattcaagccctgtttgaatgagtccttcgtgggccagtgctgggctgggaagagggtaacagcaaataatcattggttgagctaggcttatctttttgtctagtgcaacagattgagggtaaaacagttctcaaaacagccttcaaatacctttacctaaatacttccagctccttcttccagctaaagctcagtacactaatgcctcatcttagcagtgattttgtagcaattcgaagaaattttctcatccgttttaagaaaacctgactgagttttcctgtctaaacagcatttctgccaaacttaaaaggaggcccacatgatacccattc

SEQ ID NO: 236 - DNA, 571 bp, Equus caballus
  Oligonucleotide Sequence
tcctcatcagagtcacccaaggaacttatgcagatgccatgtcctcactccgaatcctcactctgggagtggagccaggtgtctgcatttgaacagggtgagggggtgggttgcctgctggacaagggagctgagccagcagctccggactctgtcctgtggcttttgtgtgtctctcccatgttctccctcccaggggcccaccacttcatgttctctacagagctaagatgatggccttgcttgagagaggtccatcccccgtggttggggtcacttagcagcgacttcttggactgccatccagccacagtggccccacagagctgtccagagccgaggctgtgggctgcagtcccagtgagcagggacgttgcccgctgttggtcatgacaaccaaacgagtccgagggcacagccaggtgtcttccaccagcccatgagctgagaatgctaagtcaccagacaaccagaaattgagtctctgtcaggatccttttgaagtgtaaggagagagaaacttacactttgaaaggttttgagcctcatccaggacaataaaaataactgt

SEQ ID NO: 237 - DNA, 2138 bp, Homo sapiens
cggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggagttaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 238 - DNA, 1293 bp, Homo sapiens
  exon (1)..(1293)
atggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtag

SEQ ID NO: 239 - DNA, 416 bp, Equus caballus
  Oligonucleotide Sequence
agggcgtcacgctgaccgtgatggtcaacaccagccaaacgcaggtttcggagaagctcgtctacaccaacccaggtggtgagggcaccgccgcccagaacttctcatgcttcatctacatcgtgcacttcatgatctgcacttgggccccgggccgcgcggcccccgacgacgtccagtatttcctgtatatacgagactccaagaagcgggagagggaatgtccccgttacatgagcgactcggggacccacgtgggctgccacctagacgacctctcgggattgacctcttacaattacttcgtggtgaacgggaccagccaaacgacggggatccagttcttcgattccgttatgcggtccaagcaaatagagaggtacagcccgcccgccaacatcagcgtgcaggtaaac

SEQ ID NO: 240 - DNA, 495 bp, Homo sapiens
gacgcagacatgcagatctttgtgaagaccctgacgggcaagaccatcaccctcgaggttgagcccagtgacaccattgagaatgttaaagctaaaatccaagacaaggagggcatcccacctgaccagcagcgtttgatttttgccggcaaacagctggaggacggccgcactctctcagactacaatatccagaaagagtccaccctgcacttggtgctccgcctgcggggcggcatcattgagccttccctccgccagctcgcccagaaatacaactgcgacaagatgatttgccgcaagtgttatgctcgcctgcaccctcgtgctgtcaactgccgcaagaagaagtgcggccacaccaacaacctgcgccccaagaagaaggtcaaataaggttgttctttccttgaagggcagcctcctgcccaggccccatggccctggggcctcaataaagtttccctttcattgactggaaaaaaaaaaaaaaaa

SEQ ID NO: 241 - DNA, 387 bp, Homo sapiens
  exon (1)..(387)
atgcagatctttgtgaagaccctgacgggcaagaccatcaccctcgaggttgagcccagtgacaccattgagaatgttaaagctaaaatccaagacaaggagggcatcccacctgaccagcagcgtttgatttttgccggcaaacagctggaggacggccgcactctctcagactacaatatccagaaagagtccaccctgcacttggtgctccgcctgcggggcggcatcattgagccttccctccgccagctcgcccagaaatacaactgcgacaagatgatttgccgcaagtgttatgctcgcctgcaccctcgtgctgtcaactgccgcaagaagaagtgcggccacaccaacaacctgcgccccaagaagaaggtcaaataa

SEQ ID NO: 242 - DNA, 1926 bp, Homo sapiens
  misc_feature (1289)..(1289): n is a, c, g, or t
gaattcctttctaaaatccaaccattccaggaaatagaaatatcaacttgggggcttcctgagaatgtcagattgatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcntgaggccatcaactttggctccttcaccatcaagtcggatgtctggtcctttggtgtcctgctgatggagattgtcacctatggcaggatcccttacccagggatgtcgaaccccgaggtgatccgagccctggagcacggatacaggatgcctcgaccagagcactgccccgaggagctttacaacatcatgacccgctgctggaagaacagccccgaggagcggcccaccttcgagtacatccagagtgtgctggaggacttctacaccgccaccgagagccagtaccaacagcagccgtgatgggtgggaccagggcagggcagggggtgcccaggtggtggctgcaaggtggctccagcaccatctgccccggggcccactcacccttcccactcccagacacccactctcgctccagccacagttcctcatctgtcaagggggtgggttggactggacaatctctttttgactctagcaatccacaatctgccattctcaggagacccccaagttgacatttctatggcctgggagagttggattccactcacagctgtggtttggatgggaaactttaaaaataatgaaataaatatttaaataaaagatataaatgccaaagtctttacc

SEQ ID NO: 243 - DNA, 1518 bp, Homo sapiens
  exon (1)..(1518)
  misc_feature (1214)..(1214): n is a, c, g, or t
atggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcntgaggccatcaactttggctccttcaccatcaagtcggatgtctggtcctttggtgtcctgctgatggagattgtcacctatggcaggatcccttacccagggatgtcgaaccccgaggtgatccgagccctggagcacggatacaggatgcctcgaccagagcactgccccgaggagctttacaacatcatgacccgctgctggaagaacagccccgaggagcggcccaccttcgagtacatccagagtgtgctggaggacttctacaccgccaccgagagccagtaccaacagcagccgtga

SEQ ID NO: 244 - DNA, 640 bp, Equus caballus
  Oligonucleotide Sequence
agtcctctcgatgaagcttcttcccacctagaaagaagtcctctctgagactcaagggctaaggcaaggtcttccagaaaacaaggctttgactccaagaacagaggtgatggggagacttcttggctcggcggggaaaggaggacgccaatgggtcaaactaactctgaatccctccctccatctctctttttccactgtcgtcagagccaacaagaaatgacagcctccaagccttcctaaaagcacacttgcccccgcctgccacctctcctcaggctgctgccctcccaggcgctccacagcgaaggggtgtggtgtttcctgcaggccaggccagctgcctcagccccgccaaaactgtgttcccagccagcgctctggagcagggatgacgtgtggccagcccttctcaggtctcagctctgctgggatgggaggagaggccagggagaaaggttaggggcccaggggtgggtgacaacgctggctgctgaaagcccatgagctgcttctttgttctctgtcacgggacaaaaatctctcatcctattctgctttcagttcattaagagagcacattttactcatacacaaataaaagttttcccttgtggaaacaacagctttaaaagaaagg

SEQ ID NO: 245 - DNA, 629 bp, Equus caballus
  Oligonucleotide Sequence
accgcgacttccagtacgagctggtcatccagagacagaggatcgaggtgccgggcgactcgcagaatcaatacattttcccgagtctggagcccagaccgaagcacacggtgaagatcaggacgggggacgcccgggacgcccaggacccccgctggggcgcctggagccggcccgtcgagttcggctccgaggacccggatgcgggggtcgtgcacgtgtacgtgctcgtcgtgctggggaccctgggctgcgcgctggcgctcggctgcctggtgaagaggttcctccggagacacagtctgttccagccggtcccgcgcatcaaagacaaactgaacgataaccatccgaccgacctccaggacgtctgggaggaattcccggcgggggccggaaaagccgagcacgaagaggtggtgaccgtccaggaggtcgacagagccccggtcagcgggtgaaaggtcacgggcacctccggcccccagacaccccggaagccgcccgggttttctcaaaaccgttttaagcgtttctgcagctatttttctactttttattaaaaaaataaatgtgaagtttggccaagaggcttcccgacggggggccggaaaaaaggcccaaagctt

SEQ ID NO: 246 - DNA, 2589 bp, Homo sapiens
gctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagagccctacaataaaggccgcttgtctgctttgccgtttgctgacatccttcgagactacaaggttattatggctgaaaacattcctgaaaaccctctgaagtacctgtatcctgacattcccaaagacaaagccttcggtaaacactacagctcccagccgtgcgaagtttcaagaccaacagaaagaggagacaaaggttatgttccttctgtttttatccccatctcaacaatccgaagcgattccactgagccgcagtctccatcagaccttcttcccatgtctccaagcgtatacgcagtgctgagagaaaacctgagtcccacgaccatcgaaactgcgatgaagtctccatattctgccgaatgacaggatgacctcttgacactcaaaaaatggaagcaaatggaaaactttaaggactgatctttgccaacagtcatctcttattcttcatctttgtatatacggatttccaggaaacggttgaagtctgaagctctgctctcactggcatgacactcccaattgggtgtgttgtgactgaaatgttaaaaccaaagcttcagataaacttgcaagataagacactttaaaaaattagtgttaatataataacaatattaacag

SEQ ID NO: 247 - DNA, 2247 bp, Homo sapiens
  exon (1)..(2247)
atgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagagccctacaataaaggccgcttgtctgctttgccgtttgctgacatccttcgagactacaaggttattatggctgaaaacattcctgaaaaccctctgaagtacctgtatcctgacattcccaaagacaaagccttcggtaaacactacagctcccagccgtgcgaagtttcaagaccaacagaaagaggagacaaaggttatgttccttctgtttttatccccatctcaacaatccgaagcgattccactgagccgcagtctccatcagaccttcttcccatgtctccaagcgtatacgcagtgctgagagaaaacctgagtcccacgaccatcgaaactgcgatgaagtctccatattctgccgaatga

SEQ ID NO: 248 - DNA, 878 bp, Homo sapiens
cagattttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaa

SEQ ID NO: 249 - DNA, 789 bp, Homo sapiens
  exon (1)..(789)
atgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaa

SEQ ID NO: 250 - DNA, 1677 bp, Homo sapiens
cccgggcgtctccccgcaacctcctcaacttccctagtcagtgacgcggcgccggccagaaatccgaccggaccgggctcgggggagcgtgagttgcagcatgtgccgaagcgccacctcagaagataaaaagaaatgagtctcatatttggcattcttttagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactgaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaatgtttcctccctcctttcctgtcctccctttctgtcccattaccttcagaagctctctgttgaattccaaattgtgaccccaacactaaacctaaggacagctacaaaggaaagacaactggggaaagaagacctaggactgggggaacccaaacagcctgtcctgcaagtgacatcactcacccacacgaaggagggggactgcaccttagaagcctgctctgcatccatttacccccccccaagggctttgtttcactgtttatgttcacgtgatctcaacagggaaattgtcattttctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 251 - DNA, 1104 bp, Homo sapiens
  exon (1)..(1104)
atggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactgaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaa

SEQ ID NO: 252 - DNA, 905 bp, Homo sapiens
gtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaacccccacccaagtcaactgccggtgtctcccgccctggacttgaagtcaaccccacacatgtgacagacgtcaccaggatctctgtgttcagcattgtcattcctgtggcgtgcgcactcgtgactaagagcctggtccttactgtcctgtttgctgtcacacagaagtcatttggatcctaggcccatggacccatgaggatgacctctgatctccatctacatccatctggcagttgtgccaagggaggagggaggaggtaaaaggcagggagttaataacatgaattaaatctgtaatcaccgccaaaaaaaaaaaaaaaaaaaaaaaaaaaaaa

SEQ ID NO: 253 - DNA, 705 bp, Homo sapiens
  exon (1)..(705)
atgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaacccccacccaagtcaactgccggtgtctcccgccctggacttgaagtcaaccccacacatgtgacagacgtcaccaggatctctgtgttcagcattgtcattcctgtggcgtgcgcactcgtgactaagagcctggtccttactgtcctgtttgctgtcacacagaagtcatttggatcctag

SEQ ID NO: 254 - DNA, 641 bp, Equus caballus
  Oligonucleotide Sequence
aacgaagtcatgttcctggccccactggtattctcagcttcgtatgctgcagtacctgtggacaaacacaggtggagaggtgtccagggtggggctggggaaggatcctccttctggacttgtttcctgtcagacccccaagccccttagacccaaagccagaggagcttgccactgcctttgggatatagggactgcagcctttgtttctgtgttccccagaatttgggtgacttttggttacctgggcacactcccttgttggccataatgggtcccttcagtcagtggcatggacatctggatgtccgcacctctctagaacctcaggccagcgagatcagcaaggccttttctctctatgtccagaagtcagtcaagagctgcttgacctgaatgtgttacaaggattgggatagggcagagggaagtctggggtcacatcctgagctggggcggcccctccttccctctgccctggagtggtctctgcatgggcagcaacccacctggtgggctgccaggttttagctgggatggtcaatgtgcatgtttcagaccttctgctctctctggaatgggtagtgttggatctcagccacccatcagactgtgtccggcattctttgcaataaatactt

SEQ ID NO: 255 - DNA, 2373 bp, Homo sapiens
tcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaaaaaaaaaaaaaaaaaaaaaaaaaaaaaaaaaaaaaaaaaa

SEQ ID NO: 256 - DNA, 2124 bp, Homo sapiens
  exon (1)..(2124)
atgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactag

SEQ ID NO: 257 - DNA, 544 bp, Homo sapiens
gccttataaagcaccaagaggctgccatgggacatttcctcggccacgccagcccccagcaggaaggtgggtccacgccagcccccagcaggaaggtgggtccaaatccagcaccatgacggaactggagacagccatgagcatgatcatcgacgtctttgcccggtactcgggtgccgagggcagcaagcagagcctgaccaagggggagctgaagacgctcatggagaaggagctcccgggcttcctgcagaccggaaggaacaagggtgccgtggacaaactgctcaaggacctggacgccaacggagacgccgaggtggacttcagcgagttcatcgtgtttgtggccgcgctcacgtctacctgccacaagtactttgagaaggcaggactcaaatgatgccctggagatgtcacagattcctggcagagccatggtcccaggcttcccaaaagtgtttgtggcaattattcccctaggctgagcctgctcatgtacctctgattaataaatgcttatgaaatgaaaaaaaaaaaaaaa

SEQ ID NO: 258 - DNA, 288 bp, Homo sapiens
  exon (1)..(288)
atgacggaactggagacagccatgagcatgatcatcgacgtctttgcccggtactcgggtgccgagggcagcaagcagagcctgaccaagggggagctgaagacgctcatggagaaggagctcccgggcttcctgcagaccggaaggaacaagggtgccgtggacaaactgctcaaggacctggacgccaacggagacgccgaggtggacttcagcgagttcatcgtgtttgtggccgcgctcacgtctacctgccacaagtactttgagaaggcaggactcaaatga

SEQ ID NO: 259 - DNA, 644 bp, Equus caballus
  Oligonucleotide Sequence
aactcagggagggagggaggtccctgggagcagttgcacatggagtaggcaccgggaaaggctagagaggagcagagccatgtaagcagagggctcaggactccccagacagagtcctgctcccaagggggctactggcccttcgctcagcattcctgtttcccttatatccaaaataaactttcctgagcttgtctgagtcttgaatcgttaccacggaacagctttatttcctggtaatctcaattcctgcctcttgccatacgatgccgtatgatctgggccacaaggctcttcagtcctggcctgagtgtcagccccgagctctgtgcccagacctttgctgtgcgtcctggagcaaacaaggaaccctttctgcaagtcagtttccactttgaaaagttccggggagggtgacattgctcaagccatggtcatttgtgttacgtatatttttaatgatctgtgtgtactatctttgctgttgtttacttaatatttttctttaagccaattcactttaaaaaatatttttatttaaagaaaaatctttatattgcttttgtaaatggaaaaatggatattcactataaataaaaagtaactgtaaaaagtaaatacaataaaacaaaatgtttcaactc

SEQ ID NO: 260 - DNA, 1517 bp, Homo sapiens
gccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgattctgttcctcaacaagcaagacctgctcgctgagaaagtccttgctggaaaatcgaaaattgaggactactttccagaatttgctcgctacactactcctgaggatgctactcccgagcccggagaggacccacgcgtgacccgggccaagtacttcatccgtgacgaatttctgagaatcagccccgctagtggggacgggcgccactactgctacccccacttcacctgcgctgtggtcaccgagaacatccgccgggtgttcaacgactgccgggacatcatccagcgcatgcacctccgtcagtatgagctgctctaagaagggaacgcccagtttaattaaagccttaagcacaattaattaaaagtgaaacgtaattgttcacgcagttaatcacccaccatagggcatgattaacaaagccacctttcccttcccccttgagtgatttggcgaaaccccctgctcccttcagcttggttaaatatattccaaatttagaaagcttaaggcggcctacagaaaaagaaacaggccacaaaagttccctctctctttcagtaaaaataaataaaacagcagcagcaaacaaataaaatgaaataaaagaaacaaatgaaataaatattgtgttgtgcagcattaaaaaaaatcaaaataaaaattaaatgtgagcaaag

SEQ ID NO: 261 - DNA, 1143 bp, Homo sapiens
  exon (1)..(1143)
atgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgattctgttcctcaacaagcaagacctgctcgctgagaaagtccttgctggaaaatcgaaaattgaggactactttccagaatttgctcgctacactactcctgaggatgctactcccgagcccggagaggacccacgcgtgacccgggccaagtacttcatccgtgacgaatttctgagaatcagccccgctagtggggacgggcgccactactgctacccccacttcacctgcgctgtggtcaccgagaacatccgccgggtgttcaacgactgccgggacatcatccagcgcatgcacctccgtcagtatgagctgctctaa

SEQ ID NO: 262 - DNA, 1081 bp, Homo sapiens
ctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtgagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaat

SEQ ID NO: 263 - DNA, 324 bp, Homo sapiens
  exon (1)..(324)
atggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactga

SEQ ID NO: 264 - DNA, 2125 bp, Equus Callabus
cccccgccgccgggaccgtcagccgcgcgccgccttcgccatggagcagctgagcacagccaacacccactttgcggtggacttgttccgcgctttgaatgagagcgatcctactggaaacatcttcatctctcccttaagcatttcctcagcgctggccatgatctttctggggaccagaggcaacacagcggcacaggtgtccaaggcactttattttgatactgttgaggatattcattcaagatttcagagtctgaatgctgatatcaacaaacctggagctccctatattctgaaactcgctaatagattatatggagagaaaacctataatttcctcgctgatttcttagcttcaactcagaaaatgtatggtgctgaattggccagtgtggattttcagcaagcccctgaagatgcaagaaaggagataaatgaatgggtcaaaggacagacagaggggaaaattccggaactgttggtcaagggtatggttgataacatgactaaacttgtactggtgaatgccatctacttcaagggaaactggcaggagaaattcatgaaagaggccaccagagacgccccattccgattgaataagaaagacacaaaaaccgtgaaaatgatgtatcagaagaagaaatttccatacaactacatcgaggacctcaagtgccgtgtgctggagctgccttaccaaggcaaagagctcagcatgatcatcctgctgccagacgacattgaggatgagtccacgggcctggagaagattgagaaacagttgactttggaaaaactgcgtgagtggaccaaacctgagaatctgtatctcgctgaagtcaatgtccacttgcccaggttcaagctggaagagagctacgatctcacctcccatctagcccgcctaggtgtacaagacctctttaacaggggcaaagctgatctgtctggcatgtcaggggccagagatcttttcgtatcgaaaattatccacaaatcctttgtggacctgaatgaggagggtacagaggctgcggcagccacagcaggcacgatcatgcttgccatgctgatgccagaggaaaatttcaatgccgaccatccattcattttcttcattcggcacaatccctcagctaacatcctgttcttaggcagattttcttccccttagagaaggtggaagtacaaggtgaagcttagagctttattacctgctagtattattaccattacttttaatagtgacagttttcatatatctttaccaataaaactactatccaaaaacaaatctttaatttcctttgtaagttcagctctattggctgttgcaccccttaactttggcgtgggtagctattttccttttttatgttgaaaaaatctagttattgcttttggatgcatcaagttaaaaaataaaaagactaaatcaaatttatagattcttgataatgcagtaagctatgaaactactatactctcctgatagtgtggaacattatagtactgtaattatttactagatagacttttggaagccataatagagacgctctgattgttgaaggaagggcttaaaaacagatattcaattgaaatatagtaaagcaccccaattaaggcctgggttgtgcagacaaactcgtcttggccgttgtttctaaccctttgttccacagggttagtgtcctaggcagcactccaatttcaaactgttagccacctggtgataccccgccttctcttttttgttctcctttatcctacctgacatgtattttgtgtaggatcacatggggtcagaaagtaggtgttctatcataaaagataccaagaacgacaaaaggaaatgcgtaggagagactgtagcaagggcacaagatctcactgttacccagcttcttgcgttttctgatgaaggctcttgccttccattgtctggtaaggttgttacaccagtgcgatggctttatgcaatgttgtggtgggagatgggggggttcttttattaatataaacctttgtcaaatgtttgaatggggctgaaaatgctgcattttcttgctcccacaaagctggtatgctggttaataaagtttcctaagattctgca

SEQ ID NO: 265 - DNA, 1140 bp, Equus Callabus; identical to SEQ ID NO: 108
  exon (1)..(1140)

SEQ ID NO: 266 - DNA, 528 bp, Equus caballus
atgagctcccagattcgtcagaattattctactgaagtggaggccgccgtcaaccgcctggtcaacctgtacctgcgggcctcctacacctacctctctctgggcttctatttcgaccgcgacgatgtggctctggagggcgtatgccacttcttccgcgagttggcggaggagaagcgcgagggtgccgagcgtctcttgaagatgcaaaaccagcgcggcggccgcgctctcttccaggacttgcagaagccgtcccaggatgaatggggtacaaccctggatgccatgaaagccgccattgtcctggagaagagcctgaaccaggcccttttggatctgcatgccctgggttctgcccaggcagacccccatctctgtgacttcttggagagccacttcctagacgaggaggtgaaactcatcaagaagatgggcgaccatctgaccaacatccagaggctcgttggctcccaagctgggctgggcgagtatctctttgaaaggctcaccctcaagcacgactaa

SEQ ID NO: 267 - DNA, 528 bp, Equus caballus; identical to SEQ ID NO: 266
  exon (1)..(528)

SEQ ID NO: 268 - DNA, 599 bp, Equus caballus
  Oligonucleotide Sequence
tttccttcatgttccattggaatagttaagtatgtggttccttctcagaaccaagggcaatcctgcttcactggtgtgccatttgctgaccttgtggtgctctcaggggccgcctgggcccagggcgaggcctcgacgcctgccgggctcgtgagatgctccaggtcctctcccctccctgggcggttctgggctgagggttcagggagcgtttcctttacctggaagttgtcaccatgaagttgtcacgtgcagtgtctttctctctttctctccgtcccgttgctggtgcccctgtaaagaggcttttgggaacgagtagagggcagaggtggcacaggagggtaaaggatgtcctggtgctggctcagcctggcaggggctctgctgacctcagggccgggcacagccaggatggctgttttcctgtcccagagacctgttgtgctgtgttattttgatttcccatttattcaaatgtatgtatttacaattgtaaaggggggggatgtctgaccttagtgttccaaacagaactgtatttttgcctttaaaatccagtgatataactggaaggtgaataaatgaccttatctttt

SEQ ID NO: 269 - DNA, 521 bp, Equus caballus
  Oligonucleotide Sequence
ccagactggcagacagtcgcgccctggggcttttctcacttactttccctttaggaggacagtgagtgagcaagagcagtgctctggtactcacccatggagatgcttagagaatcttttctccatgcatgtaaatttgtttaattccgttttcacagaagggctcaatttgttccttatcgtctccccattgaagtgtcgatgaagagttcctggaagatggatctctcagaactcaattaggtgaaatgccagaaagtgagaaagacagagactcaacagataggacaagaatgtttggtgcatttggatgtatctgtagaaactctgaccaacctcaaagtgaccaatttgctgaataaccagtcctctccttttctgtgaaactaactgctgcgcccccacctccataaccccacagcttgagtacttactgcttggcgggtcaccttcacactgctgctcccacccagttgagttatttgcttattattactataataaagcttttctgttgtctc

SEQ ID NO: 270 - DNA, 544 bp, Equus caballus
  Oligonucleotide Sequence
tgagagaagggggacaggggcgccctccgccagcctcccgaggcctcagtgcagtgccttcccggccgtgcctgcctgggcagacccccaagaagctgccggccctgcggggtgcccccgggccctgccttgggggctgccgcgtgcgcaggtcccactcaggatgactcgggtccagtggcccaggcggggcctgcgagtggggaccgccctctctgtgcctctctctcctgctgccctccaggcctgggggggcaccaggcccgaaccccggaagtctgcaaaattgggtgccccaagagctggaaactcaggaaaccccaggtgctcagggccccgccgtgtctgggggggctccgcggggcagacccccgttaatatatgcaattccccatccctgctctctgctccctaaattattgcccggccgcctctcccaggccccagaatctgcccacggagtcggtggggcacggcagcgcccccggtttcatatctgtatttataattatgtctaagtgtatatatgtaaagagatctttct

SEQ ID NO: 271 - DNA, 375 bp, Equus caballus
  Oligonucleotide Sequence
  misc_feature (96)..(96): n is a, c, g, or t
ctggccatagcattaacccctcgcccggcccggacacaaggaggaagctcctaggggccaggggcaggactgtggagggacaggcttcccctcacnccacccactccctccttctgccccctcccacatgcccgcctcgcctcccaccaggactctagccccagagtggctccagaaggtcccccgggcgtctgaccccagcgaagggccagccttgcttggttcagctgggggtgcttgcttgggagttcgaagtcaccctaatcacgtaaatggaactctccttttcgagcatctctcccttcccacaccttcctccgttagcttccccaaaagaattgtgttattaaacttattctcaatgagtcctcctgc

SEQ ID NO: 272 - DNA, 936 bp, Homo sapiens
atgggcaccagcctcctctgctggatggccctgtgtctcctgggggcagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcccagggactagctacgagcagtactttgggcccggcaccaggctcactgtcacagagaacctgaaccaggtgaccctacccaaggtggctgtgtttgaaccttcggaagcagagatctcccgcaccgagaaggccacgctcgtgtgcctggccacaggcttctaccccgaccacgtggagctgagctggtgggtgaatgggaaggaagtccagactggggtcagcacggaccctcagcccctcaaggagcagcccgccctcaatgactccagctactgtctgagcagccggctgagggtctctgctgccttctggcacaacccccgcaaccacttccgctgccaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 273 - DNA, 936 bp, Homo sapiens; identical to SEQ ID NO: 272
  exon (1)..(936)

SEQ ID NO: 274 - DNA, 3129 bp, Homo sapiens
cgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagtttctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagaaaaaaaaaaaaaaaaaaaaaaaaa

SEQ ID NO: 275 - DNA, 2436 bp, Homo sapiens
  exon (1)..(2436)
atgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtga

SEQ ID NO: 276 - DNA, 591 bp, Homo sapiens
cagaacggccgatctccagcccaagatgattccagcagtggtcttgctcttactccttttggttgaacaagcagcggccctgggagagcctcagctttgctatattctggatgccatcctgttcttgtatggtattgtcctcaccctgctctactgtcgactcaagatccaggtgcgaaaggcagctatagccagctatgagaaatcagatgccgtttacacgggcttgagtacccggacccaggagacttatgagactctgaagcatgagaaaccgccacagtaactttagaatagatgcggtcatattcttctttggcttctggttcttccagccctcatggttggcatcacacatgtctccctgccattaatgctagctgaccctacccctgtaatgatgctatgccccccattaacggacatcagtggttcctcttccctgttaaacacctatgctcagatgctattcattaatgtttatattctagtctcactctcttgtcccacccttcttctcttccccattcccaactccagctaaaatatgggaagggagaacccccaataaaactgccatggactggactc

SEQ ID NO: 277 - DNA, 261 bp, Homo sapiens
  exon (1)..(261)
atgattccagcagtggtcttgctcttactccttttggttgaacaagcagcggccctgggagagcctcagctttgctatattctggatgccatcctgttcttgtatggtattgtcctcaccctgctctactgtcgactcaagatccaggtgcgaaaggcagctatagccagctatgagaaatcagatgccgtttacacgggcttgagtacccggacccaggagacttatgagactctgaagcatgagaaaccgccacagtaa

SEQ ID NO: 278 - DNA, 255 bp, Equus caballus
  Oligonucleotide Sequence
ggggtttctcccctcctttccctttacccgcagtatcaagcacaagaattgttggattaaaaaaagaactgatatcttagaacccgaaagaatcaattgaataggataaatcagtacgtcagtggtggagcttttgcctgtagcttgagaggggaaaggtgggagggaaaggagaaaacgaaagctgaaacacatctcttgggtcctcctgttccgttttcaaggaccagtcagcttcccatcatagttttgccg

SEQ ID NO: 279 - DNA, 255 bp, Equus caballus
  Oligonucleotide Sequence
ggcacgagaggtacaggactttgaaacgttctacgggatgcccaatcccgggacctacaccgtaaggataagagcccgtgggtacttcaccggaatcgtgagcgagtggagcgcccccaagaactttgtgtgcgaccccgaggaggagggcgcgcgcctccgcgtccggctgaccgcctcgctgaccgcgctgggcccgctgctcgcgctggggctcctcgtcctgatctgcagaaagtactcgctgatgcggaa

SEQ ID NO: 280 - DNA, 2290 bp, Homo sapiens
  misc_feature (2240)..(2240): n is a, c, g, t or u
ggctgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaattttttttttgcaaattggttttatttttttgatgaggccgagcaactctgtccaacagattttagttttgcttggaaaccgcaaggtagtcccagaatattttagaggaattgatattgatggcaaaagaaaatttgcagctatacatttgcttgttacagttcattttctctaaaaccttatttttggtgatctaaataaagcatttcctgtcttgtttgagattttacagctgtactttgttgtgtaatgttatggttccctttctgtaaaccttatttntggtgatctaaataaagcctgtcttgtttgaaagaaaaaaaaaaaaaaaa

SEQ ID NO: 281 - DNA, 1566 bp, Homo sapiens
  exon (1)..(1566)
atgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaa

SEQ ID NO: 282 - DNA, 2825 bp, Homo sapiens
ggagctgttgcggggtccgcggggaagtcttggcggtggagccatggtcggccaactgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatctgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcctcccttgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcttcaagcaggaattatgttgcaagtaaattgaccctaaatctgcagacagtgaaataaattatgtaactaggtttctgcttctccagtggtgaccaccccccccccatccccgctcacaacttgggttcttctcagcggggcgagctgagaagcggtcatgagcacctgggtgttttagtaagcgcgtcttcctagaattcaaaggcgctctctttctagaggtgccacatagttgttaatgctcagaatggcaatagggtagaattattaatcaaagacatatcttttatatctgaagatagccttccttcagggtttaatagactgagtcagatgggtctgatattaatcaaaattgtctcttctgaggaaggctgataagcattgacttgctgtcccccagggacatccacgcaactacaaagccttgctttagtttcacttcaattaatgttgcattttggttggtgaatgcacactttttctacctgtacacattcctgcattcatgtattttgttttttttgactaaagctatgttacatggaaaggattttgaagccctttgtttctcttgctttgttttaataaacagtatattctttggttgtgaatcctaaaaaaaaaaaaaaaaaaaaaaaaaaaaa

SEQ ID NO: 283 - DNA, 1851 bp, Homo sapiens
  exon (1)..(1851)
atggtcggccaactgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatctgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtga

SEQ ID NO: 284 - DNA, 1314 bp, Homo sapiens
gtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgaaagccagagtgtgtgagaactgcatggaggtggatctgacggcagtggccacaatcatcgtagtcgacctctgcatcactctgggcttactgctgctggtgtattactggagcaagtctaaaaaggccagggccaagcctgtgacgaggggagcagatgttggcggcaggccccggggacaaaacaaggagagacccccgcctgttcccaatccagattatgagcccatccggaaaggccagcgggacctgtacgctggcctgaatcagagagccgtctgacagttcctgaggacactgcctcctgctggcccagctctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaaccccccctcccactgtaggcccctggatgttcgtttgcatctccatgaatgtgctaggctccttgtcagctgagagagaaaagaaataaagtgtatttggctgc

SEQ ID NO: 285 - DNA, 624 bp, Homo sapiens
  exon (1)..(624)
atgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgaaagccagagtgtgtgagaactgcatggaggtggatctgacggcagtggccacaatcatcgtagtcgacctctgcatcactctgggcttactgctgctggtgtattactggagcaagtctaaaaaggccagggccaagcctgtgacgaggggagcagatgttggcggcaggccccggggacaaaacaaggagagacccccgcctgttcccaatccagattatgagcccatccggaaaggccagcgggacctgtacgctggcctgaatcagagagccgtctga

SEQ ID NO: 286 - DNA, 1400 bp, Homo sapiens
ttgccggcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcaatcgccatcgcaaccggaaagatgctgtccttggcggaacagcagctggtggactgcgcccaggacttcaataattacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactgaagactttatgatgtacagaaagggcatctactccagtacttcctgtcataaaactccagataaagtaaaccacgcagtactggctgttgggtatggagaagaaaatgggataccctactggatcgtgaaaaactcttggggtccccactggggcatgaacgggtacttcctcattgagcgtgggaagaacatgtgtggtctggccgcctgtgcctcctaccccatccctctggtgtgagccgtggcagccgcagcgcagactggcggagaaggagaggaacgggcagcctggccattggtggaagtcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaactgactcaaacccacgtggaccaagaatattctttccttcctgaagggctacttttcacatatagagctccagggactgtcttttctgtattcgctgttcaataaacattgagtgagcacctcca

SEQ ID NO: 287 - DNA, 1008 bp, Homo sapiens
  exon (1)..(1008)
atgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcaatcgccatcgcaaccggaaagatgctgtccttggcggaacagcagctggtggactgcgcccaggacttcaataattacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactgaagactttatgatgtacagaaagggcatctactccagtacttcctgtcataaaactccagataaagtaaaccacgcagtactggctgttgggtatggagaagaaaatgggataccctactggatcgtgaaaaactcttggggtccccactggggcatgaacgggtacttcctcattgagcgtgggaagaacatgtgtggtctggccgcctgtgcctcctaccccatccctctggtgtga

SEQ ID NO: 288 - DNA, 1433 bp, Homo sapiens
gggaggtaagtagaaaccgttgatgggactgagaaaccagagttaaaacctctttggagcttctgagggctcagctggaaccaacgggcacagttggcagcaccatcatgatgtcacaacccaagaccaatgagaccttcatagctctcacaccaaatggcatcagcttcctccaaacagaggatcccaaacttaccaacaagaggcaggacagcctgaagaaacatctaaaggcagaggtcaaagttctcgggactatccagatcctgtgtgggatgatggtgttgagtttgggaattattttggcatcggcttccttctctcagcattttacccaagcgttttctattctgttgaaggctgcttacccattcataggagccttgtgttttgtcatctctggatctctatcaatcatcacagagaaaaagtccactaagcctttggttcagagcagcctagctgcaaacattctgagctctctatcagctctggtgggtttcatcctcctttctgtcaaacaggccaccttaaatcctgcctcactgcagtgtgagttggacaaaaataatataccaacaagaagttatgtttcttacttttatcatgattcactttataccacggactgctatacagccaaagccagtctggctggatccctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcatttaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcaaaaaaaaaaaaaaaaaaaaaaaaaaaaa

SEQ ID NO: 289 - DNA, 747 bp, Homo sapiens
  exon (1)..(747)
atgatgtcacaacccaagaccaatgagaccttcatagctctcacaccaaatggcatcagcttcctccaaacagaggatcccaaacttaccaacaagaggcaggacagcctgaagaaacatctaaaggcagaggtcaaagttctcgggactatccagatcctgtgtgggatgatggtgttgagtttgggaattattttggcatcggcttccttctctcagcattttacccaagcgttttctattctgttgaaggctgcttacccattcataggagccttgtgttttgtcatctctggatctctatcaatcatcacagagaaaaagtccactaagcctttggttcagagcagcctagctgcaaacattctgagctctctatcagctctggtgggtttcatcctcctttctgtcaaacaggccaccttaaatcctgcctcactgcagtgtgagttggacaaaaataatataccaacaagaagttatgtttcttacttttatcatgattcactttataccacggactgctatacagccaaagccagtctggctggatccctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaa

SEQ ID NO: 290 - DNA, 818 bp, Homo sapiens
gcctcgaggcgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggagaaggccagtctgccaggagtgaagaaagctttgggcaagtatggtcctgcggatgtggaagacaccacaggaagtggagctaccgatagtaaagacgacgatgacatagatctctttgggtctgatgacgaggaggaaagtgaagaagcgaagaggctaagagaagaacgccttgcacagtatgagtcaaagaaagccaagaaacctgcacttgttgccaagtcttccatcttactagatgtgaaaccttgggatgacgagacagatatggcaaagctggaggagtgcgtcagaagcattcaagcagacggcttggtctggggctcctctaaactagttccagtggggtatggaattaaaaaacttcaaatacagtgtgtagttgaagacgataaagttggaactgatatgctggaggagcggatcactgcttttgaggactatgtgcagtccatggatgtggccgctttcaacaagatctaaaacccgtcgtggatcatggcatttaaataaaagattgaaagatta

SEQ ID NO: 291 - DNA, 678 bp, Homo sapiens
  exon (1)..(678)
atgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggagaaggccagtctgccaggagtgaagaaagctttgggcaagtatggtcctgcggatgtggaagacaccacaggaagtggagctaccgatagtaaagacgacgatgacatagatctctttgggtctgatgacgaggaggaaagtgaagaagcgaagaggctaagagaagaacgccttgcacagtatgagtcaaagaaagccaagaaacctgcacttgttgccaagtcttccatcttactagatgtgaaaccttgggatgacgagacagatatggcaaagctggaggagtgcgtcagaagcattcaagcagacggcttggtctggggctcctctaaactagttccagtggggtatggaattaaaaaacttcaaatacagtgtgtagttgaagacgataaagttggaactgatatgctggaggagcggatcactgcttttgaggactatgtgcagtccatggatgtggccgctttcaacaagatctaa

SEQ ID NO: 292 - DNA, 2788 bp, Homo sapiens
ggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaaaaaaa

SEQ ID NO: 293 - DNA, 2517 bp, Homo sapiens
  exon (1)..(2517)
atgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctga

SEQ ID NO: 294 - DNA, 1347 bp, Equus caballus
tgaaggtcaggcctggcagccgtccccaggcgagaagcgacaaggagaaagaatgcagagctacaggctacagggtgctggccctgagatctccactttctgcatcctccagaagttgtcgagaacaatgcccattttgtacatgttgatattgggtgttcccgccttcaccattcagcctgaggagcgcacagtgactgcaggaaactgccaatttcttggcaagcatttcaaaaccgacctcatggtggaaagggagcctgtggtcctgaggtgcccccaggcatggtataggtggttggactctgccagctcacatgtcaacgtgacgtggcgtaaaaacgattctactaggatggttccagaggaagaagagacgcgaatgtgggtccaggacaatgctctctggattttgccggccttgcagggggactctggcacctacatctgcactgtcagaaacgcctcgtactgctatgaaatgtccactgagctcagggtttttgagaagacagaagctgccctgacttacatctcatacccgcagatcctaaccttgtcaacctctggcttactagtttgccctgagctgagtgaattcacccggaacaaaactgacgtggaggttcaatggtacaaggattctgtccttttggatcaagacaacgagaagtttctaagtgtggcaggaccccctcgtttacttgtacaaaatgtgtctatggaggatgcgggctattacagctgtgtcatgaccttgatccacaatggcacacgagtcaacatcactagaaatatcgaactccgtgtccagaaaagaagagaggagactgttcctgtgattgtctccccccgccagaccatactggcttcactggggtcaagactgataatcccgtgtaaggtgtttctgggagccggcacacagtggaccaccgatctgtggtggatggccaacaacaccaacatagacattgcctaccggggaggtcgcgtgacggaggggcagcgccaggagtactcagaaaataatgagaactacatcgaagtgccattgatttttgatccagtcataagagaggatttgaacacggattttaaatgtgttacctataacacacggagttttcagacgctacataccacagtcaaagaagccgccacgttcccctgggggactgtactggcccctcttttgctggtcttcttggttttgggaggaatatggatgcgcaatcggtgcaaacacagacgtggaaaagcgtatggtttgactgcattaaagattgagcgtcaagtttttcaatcttatccaagtaaaataaaggaaataaaataattcaaata

SEQ ID NO: 295 - DNA, 1212 bp, Equus caballus
  exon (1)..(1212)
atgcccattttgtacatgttgatattgggtgttcccgccttcaccattcagcctgaggagcgcacagtgactgcaggaaactgccaatttcttggcaagcatttcaaaaccgacctcatggtggaaagggagcctgtggtcctgaggtgcccccaggcatggtataggtggttggactctgccagctcacatgtcaacgtgacgtggcgtaaaaacgattctactaggatggttccagaggaagaagagacgcgaatgtgggtccaggacaatgctctctggattttgccggccttgcagggggactctggcacctacatctgcactgtcagaaacgcctcgtactgctatgaaatgtccactgagctcagggtttttgagaagacagaagctgccctgacttacatctcatacccgcagatcctaaccttgtcaacctctggcttactagtttgccctgagctgagtgaattcacccggaacaaaactgacgtggaggttcaatggtacaaggattctgtccttttggatcaagacaacgagaagtttctaagtgtggcaggaccccctcgtttacttgtacaaaatgtgtctatggaggatgcgggctattacagctgtgtcatgaccttgatccacaatggcacacgagtcaacatcactagaaatatcgaactccgtgtccagaaaagaagagaggagactgttcctgtgattgtctccccccgccagaccatactggcttcactggggtcaagactgataatcccgtgtaaggtgtttctgggagccggcacacagtggaccaccgatctgtggtggatggccaacaacaccaacatagacattgcctaccggggaggtcgcgtgacggaggggcagcgccaggagtactcagaaaataatgagaactacatcgaagtgccattgatttttgatccagtcataagagaggatttgaacacggattttaaatgtgttacctataacacacggagttttcagacgctacataccacagtcaaagaagccgccacgttcccctgggggactgtactggcccctcttttgctggtcttcttggttttgggaggaatatggatgcgcaatcggtgcaaacacagacgtggaaaagcgtatggtttgactgcattaaagattgagcgtcaagtttttcaatcttatccaagtaaaataaaggaaataaaataa

SEQ ID NO: 296 - DNA, 1492 bp, Homo sapiens
gttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagcctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttttgatgcacagccacatgcattcttcctcagtggaccagcttcgccaggggcttcatctgcaacatcctcaccattaaaaaaagaacagcccttattcactctacggcaggttgggatgatctgtgaacgtttgttgaaagaacgtgaagagaaggttcgagaagagtatgaagaaatattaaacacaaaacttgcagaacaatatgatgcatttgtgaagtttacgcatgatcaaataatgcgacgatatggagaacagcctgctagttatgtttcatgaatcacgttttctgcatttgtgggctgccttgttctttgttgaattgttgcaagaggtcccaattatgacatgcagcaatgccaatacccccctatgaatacaggttatttcaagctttcgtcagtggcaaccactttaggcagcaactggttttggaaatttccctgatgtcaataccacccggatgtggacctttgctacctgtattaataccagtggcctcatttgctgtatcattacaatttggcttcttacattaatgtttgaaaaggattaaatctggtattctaagaacatgcccttcactggttgtgtaaataaaactgtagaatgacaaaaaaaaaaaaaaaaaaaaa

SEQ ID NO: 297 - DNA, 612 bp, Homo sapiens
  exon (1)..(612)
atggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttttgatgcacagccacatgcattcttcctcagtggaccagcttcgccaggggcttcatctgcaacatcctcaccattaaaaaaagaacagcccttattcactctacggcaggttgggatgatctgtgaacgtttgttgaaagaacgtgaagagaaggttcgagaagagtatgaagaaatattaaacacaaaacttgcagaacaatatgatgcatttgtgaagtttacgcatgatcaaataatgcgacgatatggagaacagcctgctagttatgtttcatga

SEQ ID NO: 298 - DNA, 6474 bp, Homo sapiens
agagcgagcaggggagagcgagaccagttttaaggggaggaccggtgcgagtaaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagactttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccatctgatggcacagaaggatcttaattcccatctctatacttctcctttggacatggaaagaaaagttattgctggtgcaaagatagatggctgaacatcagggtgtggcattttgttcccttttccgttttttttttttttattgttgttgttaattttattgcaaagttgtattcagcgtacttgaatttttcttcctctccacttcttagaggcattcagttagcaaagaggttggagcaacaactttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattcttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattttgaagttttggagagggaagtggagcagccagcaagtaagctagccagagttttctcaagagccagctttgctcagcacactctcctgggccccaaggagtcccacggaatggggaaagtgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtattttgacaggtgcctgtccttgaaaaacaaagtttctatttttatttttaattggttttagttcttactggccaactcttaaatccccagcaaatcactgggccattggattttttccattatgttcattacccttgtaccatgtacctcagatctctctctctctcctctctctcagttatatagtttcttgtcttggactttttttttcttttctttttctttttttttttgctttaaaacaagtgtgatgccatatcgagtcaatgttattctctcacaatgtactctataagaggtgtgggtgtttatttggtcgggatgctagcaagtgctaaagtagcatgatcagtataaacaaaaggtttttaggaagtatggaaaaaatgttttattggctatgatggtgacatggtatagtcagctaccttttaagaggtcctatctgttcagtgttaagtgatttaaaaaaaataataacctgttattctgactagcttaaagatggatttgaaaatggttttggatgcaattaggttatgctatttggacaataaactcaccttgacct

SEQ ID NO: 299 - DNA, 870 bp, Homo sapiens
  exon (1)..(870)
atggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtga

SEQ ID NO: 300 - DNA, 5782 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttcttcgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaaaaaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagccagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacgcgcaaaacagagtaattctgagtcactaggcaccctattatggttttactgcataaggtgaaaattaactggaatgatgtttctttgctatacttaaataatcaaactttacaagccatgaaattaattgcactctttttgtttttattgttgaatgcctaagaagttttctaaaaaaatttgcagaggcactgtcagataatttggagttgagtaactactccagatactgtataactttttgtctttaagtcgtgtttgtataagaaataattgttagaaacatttgataatgtacaaagtagtctataatgacactgttcagtacatttttatattttttgttacatcccactttttgtaaatatcctcagagaagcttgataataaaatgtatttcctatcaccatacttttccatgtgaaaacctgagcctatttctagtataagtatccaaagaaaagttttacctggttgtgttattttaccagac

SEQ ID NO: 301 - DNA, 2673 bp, Homo sapiens
  exon (1)..(2673)
atgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaa

SEQ ID NO: 302 - DNA, 5775 bp, Homo sapiens
attcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttc

SEQ ID NO: 303 - DNA, 4062 bp, Homo sapiens
  exon (1)..(4062)
atgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctag

SEQ ID NO: 304 - DNA, 621 bp, Equus caballus
  Oligonucleotide Sequence
ggcacgagggcccctacaaatgcaaaacccaggtttctaactgttcaagatatagtcaagagttcagcttcacgtttgccaacccagtgaccacaccagtgctgaacattagtgcctttcaaacagaaacagcccgatacataacactccgctgcatctcatacaatggctctctgcccatcaattacactttctttgaaaaagacgtcgccatatcacctgctatttccaagaatgtaagggaacctgctgaatttaacttaaccgagaggatcaccgtgacaaagggaagaatataggtgtaaagccaaaaacagattgcccaaccatgcaaaatacagtcaacccttcaccatgccctcaacaggcggagacagctgtcctttctgcctgcagctactgcttccggggttattactgctgctgatagtaataatcctaatgctggcattttggatactaccaaagtacaaagcaagaaaagctatgagagataatgcacccagaaactatggaaataaacccatggaagttggaatatatgcaaatgtctgtcaaaaccaagcagatgacaaatctgtgccaggcttggaaccaaggcagtgtgtttccacagcccaa

SEQ ID NO: 305 - DNA, 618 bp, Equus caballus
  Oligonucleotide Sequence
ggcacgaggaactttcatatattgtgccaggtgctagggatacagtgataaacaaaattatcatggttcctgctcctggagatcttatggtatagtaggataaacagaattaaaaaaataaaaataaatatttaatgacaaatgacatggaggttgtgaaagaataataaggggatccattttagatggaatggtctgagaaggtctgtcttcgaaggtgacatatgtaagctgagacctaaagaaaaggaggaaccaggcaggcagaggaaaggccttgaggcagatgtaaaaactgtgacatagagaactctttcctctaacagaggagctgaaagaagctcagggaggctaaatagagatagtgcggggagagtgatgatagctgaggcttgagatgggtcagaccatccagggccagggagactcagtttcattctgagtgcactgggaagtcttgcagcgttttaagcagacaagcgaaggatctgatttatattaaaaatattactgttgtaatattgtcttgtcttgtggagaatggattggaaggaaaaacgagcaacagttgcagagagttgttcagaatttgttgtagtactccaggtcagctcgtgc

SEQ ID NO: 306 - DNA, 369 bp, Equus caballus
  Oligonucleotide Sequence
tttaatcgttaattgttttttcccttgtccgtttttatttgggcatccaccacagacaatttaaatttcgtagatgcgctcagaacgcagcagcagggtacgtagcagaaatgcaaaggtggacaggtagtacaattactggcttttctgctgtaaatagaatgaaggaaaatgactcaaatcaagtaaaactaacacacatgatttgattgacaataaagtatttgccatcacatgctgcagctgtttgtcaggaacatggtgtcattcattcattcagtaatcacgctgcagaaattggcagcctgcaccttatgcgtcaccattacctttagtcgtttttttgtattaattgtagccaactcgtgc

SEQ ID NO: 307 - DNA, 5601 bp, Homo sapiens
ggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcaaaaaaaaaaaaaaaaaa

SEQ ID NO: 308 - DNA, 3111 bp, Homo sapiens
  exon (1)..(3111)
atgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtga

SEQ ID NO: 309 - DNA, 3875 bp, Homo sapiens
  misc_feature (1996)..(1996): n is a, c, g, or t
tctagagccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctgaagaagatgattcctctgctagtacctcccagtccactcgagctgcttctatctttggaggggcaaagcctgttgacacagctgctagagaaagagaagtagaagaacggctacagaaggaacaagagaagttgcagcgtcagtggaatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaacatctcctgaagacctttcttacctttttttaaaaacaaaaantgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctcatttagcagaaatggtaatgacagtgatataatgcctggaacctggttgggcagtaggggagggaggtagaaggaaaagtgtgagatttctaccttttagttttcatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattcctttttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcgtcatcttaagttcttcatgctactcttaacctcccaaaaagcagtatctaagtcacatacatgatgtcttgggcattttctgagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgttttttttttaagcttcccttgagagaataagtgataatggagagagctgtgtaacaagatccaggtttctcttgcaatacagtagctaaacttgcctgcttttatatgcatttttgtagggatcagcttggtagacagtattagcggagaaacaccttgatcttggtttgcaaggcctcctccggtcagtcctaggttagaccctgtccagccacgcggggctgttggtgtttgagtgctgcagcagtgggcagaatgaatcatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagatgatgaaaaggtagggtttgccctcttcatgtctactccttccaaatagttgtatccaaaactgtttttccctctcccctaccttgtcccccctattaaaatagaaacagggattgatttatgtcccactcctcaatacgtgtaaaatttgtacaaaaatatcttctatgaaaatgatttgtaatctgtagacaatacctgggagatgtcttgagatgtaaaatcccatcctttcggttgtgggattttttgttttctccaaataaatctgatctttaaagttaaaaaaaaaaaaaaactctagagtcgaggaattc

SEQ ID NO: 310 - DNA, 1836 bp, Homo sapiens
  exon (1)..(1836)
atggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctgaagaagatgattcctctgctagtacctcccagtccactcgagctgcttctatctttggaggggcaaagcctgttgacacagctgctagagaaagagaagtagaagaacggctacagaaggaacaagagaagttgcagcgtcagtggaatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatag

SEQ ID NO: 311 - DNA, 652 bp, Equus caballus
  Oligonucleotide Sequence
ccccattttcacacctgtcttccgatcttcacacctgccttccccatgttcacacctgcctccccatcttcacgcctgtcttccctgtgttcacacctgtcttcccatattcatacctgcattccccatgttcacacttgcctctccatcttcacaactgccttctccatgtttatacctgcctttctcaccattttggtttgaaagacagttttccatggatgtttttttccagaaagtcagtattattttttaaataagaaaaatactccttaaaagatcacaattgtgaaaactactgtggcctttctgcttttccagattttagtctcctttctccccatcctctgatccagcaaagatggtgaggacaaagtggtaaacttctctgcactccatgatggtctacacatggtctgacctgcactgtttctggcacccactgaaaaagaagttgagtagacagtgtagagtacagaaatgtggcttttgcctaacacttttgcatctccaaagtcttaagagttggttcatcccatttgaggacaatgttcagttgtacatctcagagttggaaatggaagaaagcagagggagtctattttcactcattctttcaataaatatttattgagcaccaaaaaaaaaaaaa

SEQ ID NO: 312 - DNA, 2919 bp, Homo sapiens
gaggagctctcctgggcggctgaagaaggagcttcttctccggagtgcgaaggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttaaacggggctgaaggagtgttcctcctttatgtgaaaagaaaatcattttactcttcattttgactttttgactgttgggctcacttccagttagtttgaatgaaagtactaattttctacttggagttgaggagggcagaatccgcagctctcatcattgtgatgtgtagcatgtctgccctctgactggacatcattgccattaactttcttctgggcatcacggcagtgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctagtattcagaaactgcgaagtaggaaaaggttgatatggaaacaatccctttcccttcctcaatgtacatagttcaaatctttctttgttacatttaaactatatccgtgtatgtcagtctgttttggactcctctgctagtgttacagatggaaataaaaccattaatttgaaccaaaaaaaaaaaaaaaaaaaaaaaaaaaaaaaaaaaaaaaaa

SEQ ID NO: 313 - DNA, 573 bp, Homo sapiens
  exon (1)..(573)
atgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatga

SEQ ID NO: 314 - DNA, 1324 bp, Equus caballus
  Oligonucleotide Sequence
ttctttacaacatggttttagtggagtagatttcttaagacaggaaacattttcttttttttctttacaacatggttttagtggagtagatttcttaagacaggaaacattttcttttttaaaggcattgttccttccagtccatctcgtttctttataaagaaataaagtgactttattttaaacatagttccactgtcatttctgaaaaatgtaatgctctttaagtcatagcaccggtaaacaaagtaagttatgtaagggggaaatggttgcagcaaactttttaactgattttgtcaaaccaactaataggttactgcttcccacactacattggttcaaaaacaaaaaaaagctcgacagcactcaggtcctaaagaagaaatttagctcataataaagaacatctgttatggaactaaacaactgaaataggcttggttttaagagttccggtatctaagtcacaatttgaaacatttctaataaacagtatctcttggagtttcagtactgtcacaaagtagtgaataagcatgtgcaggggtaaatgtaaggattgttaacctatataaacagaattttaaatttcagtgtgttttattctgatttttaagacaagaggtggtctgtaatggattcaaatgtttcatttgtagtataatgaaatgtttacagaaagaactttttcattaaaatatttttagaaaaaaaaaaaaaaaggcattgttccttccagtccatctcgtttctttataaagaaataaagtgactttattttaaacatagttccactgtcatttctgaaaaatgtaatgctctttaagtcatagcaccggtaaacaaagtaagttatgtaagggggaaatggttgcagcaaactttttaactgattttgtcaaaccaactaataggttactgcttcccacactacattggttcaaaaacaaaaaaaagctcgacagcactcaggtcctaaagaagaaatttagctcataataaagaacatctgttatggaactaaacaactgaaataggcttggttttaagagttccggtatctaagtcacaatttgaaacatttctaataaacagtatctcttggagtttcagtactgtcacaaagtagtgaataagcatgtgcaggggtaaatgtaaggattgttaacctatataaacagaattttaaatttcagtgtgttttattctgatttttaagacaagaggtggtctgtaatggattcaaatgtttcatttgtagtataatgaaatgtttacagaaagaactttttcattaaaatatttttagaaaaaaaaaaaa

SEQ ID NO: 315 - DNA, 580 bp, Equus caballus
  Oligonucleotide Sequence
gctttccttcagggctgtcaagactgccgtgtgcccgaggtatgcaggtttacttcagaaaacacgagatggtacccaacgcatcacctttggaagccagcggcaatgccattctgctactatccactgacttcccacagatttgttatcctcaacagaggatgtaacaccaccttgccatggttgtccaaatctggattttagacatttcaattaattgagactgtgatttggttcttccttcccatcatgcattctggcatcaagtccctttcagtgttctgaagttagactgaagtttctttgacccaagactacaaaggtgagaccctgaagtaaagacaaggtacacgtacattatctgagtaaccatttcctttgtggccaatctgtgtatgcttttagaagtttacaagatgctttatttttgtctgtaacagtctctgtcattcatttctgtcgataaagtattgggacagaatgaggaagtttgccttgtatctcctagtgctaacaacacactccagtcacgagccgggctttacaaaataaagcactttgacgactcaaaaaaaaaaaa

SEQ ID NO: 316 - DNA, 1719 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcctgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgagacttccaaacgtgtggtgattctaactcgggtttgggcttttctttaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattgagaactaattcccttttttagtctgtttgtttctgtgtattttctaaaaagctttacacccttggtgccttggagcaaatatttcttctgaaccttgtcattttcgtgaataattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacatttt

SEQ ID NO: 317 - DNA, 1173 bp, Homo sapiens
  exon (1)..(1173)
atgggcagagcgggactcgaggccccgcccccgccttgtggcgtcacggggacgccgggggcgcgcgggctgcagggccgcgtaggtccccgcccccagagtctggctttccgcggctgcctgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgagacttccaaacgtgtggtgattctaactcgggtttgggcttttctttaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtga

SEQ ID NO: 318 - DNA, 3751 bp, Homo sapiens
gtaattgttaactaatgtgcattttaaaattctcatttgtcttatgtactgagcccttataccagtgctaatttatgtgactcctttctcctgcagctaagagaaaaatacctttttaattcatttatagtacccagtttttaaagaagatttattttgtaaaattttgcttatggtacatgtcatcttagcctgtaaataaattaaagcattaatttttatccctccctggtcttttcctccttctgactttatacgtctttctagagagcttatcttctataataacaattctttgttttaaagtgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttaaatcattgctaatgtagaaatgttaagtggaaaaacatacaatttgctaaaataaactagattccagattcatctctgggtttttttcccctcctttctttccacagcacttttgatatcaaacaagtggcttcctttttgagatattaaaaaaaaaaagaaaaggaaaaaagtaaatgaagcccaactacctaaccctttcttatttgtatttgttttagtattgtgaggttgtgttaaatagtactagctagaaatacaaatttctggttatcatttatcctccctgtggcacttgacattttaattgtcttaaaccttttggtgtacatcctctggccccttaagtgctgccagaagcagaagatatctgtctcattcattccacttgcactgtctcctgggatcttgtctgcagcccgacgtgtggctgggaaatggactcgagaagattggcttcaattagatccataatcatgtgtgatcccatcatgagttcattggaatttgtgttgcatgtaaggcaatctttcctgttgtaaatcttcctttttttatgtacatatattttgaaaaatatgaataaacatgaaattttaaaaaaaaaaaaaaaaaaaa

SEQ ID NO: 319 - DNA, 1206 bp, Homo sapiens
  exon (1)..(1206)
atggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaa

SEQ ID NO: 320 - DNA, 665 bp, Equus caballus
  Oligonucleotide Sequence
ttatttatttaggatataaatagcagaaaaccaattactatgtcagagtatggacacttgatacataatgccaaattattcttcataagagctgttgccaaatcagtgataatattcatttcactgtactcttgccagccatcactccagtgatggttgtggtggtggttgtcgtcatttgggggcaggtgcctaatgtgcggtctttaatgaatatctaatgaatgtttgaaaaaaatgattattctctgtttatcaggtacaaaggtatttatggtacatgtatatggtatgtgtatatgacttgtcaaattactattaacattttctatagccttagataatgcatgaaaaagcatagttcagtgccactcacataagaagtgcccaataagtgttaactattatttttgtctacttggttttaccaccttctaaaagtatgttgaagtgtctctctgtcattgtggatttgtcagtttctctctgcatttctcagagtacttgttttatatattttgaagctattgttagatgatagattcatgatttgtagtggaatgttcttttatcaatttttgaaaattgcccttgtctcataatgcttttcatattgaattctattttgtctgctattaaatatttccatacctgcaaaaaaaaaa

SEQ ID NO: 321 - DNA, 3775 bp, Homo sapiens
cgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttaaaaaaaaaaaaaaaaa

SEQ ID NO: 322 - DNA, 1728 bp, Homo sapiens
  exon (1)..(1728)
atgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataa

SEQ ID NO: 323 - DNA, 4626 bp, Homo sapiens
gaattcccctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatagaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatgggtataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttctt

SEQ ID NO: 324 - DNA, 3750 bp, Homo sapiens
  exon (1)..(3750)
atggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatagaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaa

SEQ ID NO: 325 - DNA, 3293 bp, Equus caballus
ggcacgagcggcacgagagcagcagctccgaggctgccctggcgggcaggctgttacggtgcgtcatgctttcacagggccccttctgggcacagaaaatgccaggatgatgccgcccacccgcctggctgggactctgatcccagccatggccttcctctcctgcctgagacccgagagctgggacccttgcgtgcaggtggttcctaacactacttaccaatgcatggacctgaatctctacaaaatccctgagaacatccccacatcaaccaaggaactggacctgagctttaaccccttgaaggagttaggcagccatagcttctccaacttcccagaactgcaggtgctggatttgtccaggtgtgaaattgagatgattgaagatgatgcatatcagggcctcaaccatctctccaccttgatattgacaggaaatcctatcaggagcttagccctgggagccttttctggactctccagtttacagacgctggtggccgtggagacaaagctttcatctctagagaagttccccattggacatctcaagaccttgaaggagcttaatgtggctcataatcttatccattccttcaagttacccgagtatttttctaaaatgcccaacctggagcacttggacctttccaataacaagatccaaaatatttctcatgaagacttgcgtgtgctacatcaaatgcccttactcaacctttctttagacttgtccctgaatcctttagagtttatccaaccagatgcctttaaagaaattaagctccataaactgactttgagaagtaattttgatagtatagatgtaatgaaatcttgtattcaaggactggctggtttaaaagtcaatcggttggttctgggagaatttaaaaatgaaaggaaattggaaagatttgacacatctgccctgcgcggactgcacaatttgacgattgaagaattccggttagcatacattgataattacagctcaaaggattctattgatttacttaattgtttggcagatatttctaaaatttctctggtgagtctggatttaggcaatctaaaagattttcctaaaggtttcggatggcaagacttcgaattggttaactgtagaattgaaggatttcccacattggagctcacctctctcaaaaggttggttttcacttccaacaaagatatgaaatcttttaatgaagttaagctaccaagccttgagtttctagatctcagcagaaatcgcttgagtttcaagtcctgctgttctgaggctgatttgaagacaaccagactgaagcatttagatctgagcttcaatgatgttatttccatgagttcaaacttcatgggcttagagcaactagaacatctggatttccagcattccactttgaaacaggccagtgattttccagtattcttatccctcaaaaacctccgttatcttgatatttcttacactaacacccgagttgtcttccatggcatctttgatggcttggtcagcctccaagtcttgaaaatggctggcaattcttttaaggacaacttccttccaaatatcttcagagagatgactaacctgaccaccctggacctttctaagtgtaacctggaacaggtgtcccaggaggcattttgcttactccctcgacttcgggtgttaaatatgagtcacaataacctcctgttcttggatatgcttccttacaaacctctccattccctccagattctggattgcagttttaatcgtattgtggccttcaagtggcaagaactgcagcattttccaagtagtctagcttccttaaatcttactcaaaatgactttgcttgtgtttgtgaataccagagttttctgcagtgggtcaaggaccagaggcagctcttggtggaagttgaacacttggtgtgtgcaatacccttacagatgcggggcatgcccgtgctgggttttaacaatgccacctgtcagattagcaagactatcgttggcgggtcggttttcagtatactcatggtttctgtcatagcagttctggtctataagttctatttccacctgatgcttcttgctggctgcaaaaagtatgggagaggtgaaagcatctatgatgcctttgttatctactcaagccaggacgaagactgggtgaggaatgaattggtaaagaacttggaggagggggtgcccccctttcaactctgccttcactacagagacttcattcctggtgtggccatcgccgccaacatcatccaggaaggtttccacaaaagccggaaagttattgtcgtggtgtcccagcacttcattcagagccgatggtgtatctttgagtatgagattgcccagacctggcagtttctgagcagtcgtgctggcatcatcttcatcgtcctgcacaagctggagaagtccctgctccggcagcaggtggagctgtatcgccttctcaacaggaacacttacctggagtgggaggacagtgtcctggggcggcacatcttctggagacgactcaggaaagccttgctggatggtaaaccgtggagtccagcaggaacagcagatgcagcagaaagcagacaacatgatgcagaaacctctacctgaggaggaaaaactcctgaggtgcttcttgcccagctggacccaatacttgttcagttaacaactattaaatgctgcaacataccaggcattgtgctaggggcaggtgattctgtcgtgcacaagatacacaggactgctaatccctttgagtttacagtgcagagggaataaatgccgtgctaaaatacagaacctccagggggatgttttaaccaagtcagctaaggagtccgtgccagggaaagtcaactcaactcttaccccatcaaaatgaatcagaactgagagactgggccccagtgagttcagaaaaggacatcgtctcccaagtcttttgaatggaaaccatctcatctttgacatcttagccatcctaaaacaaaacaaagcagttttggtactttcaactgaacagcgtctctgttcaattttcccttttctactgaacacaatttaaattttacttgatgactcagaaggctcctgattcagatcctccctcctctttaaggcagtttccttatgaaggttaaactcttacgactaattcctaaggaaatctgattgatacatattcacaaacatcctggtcattctttagcgtgctctatttattaataaatagcaggttctatttaaaaaaaaaaaaaaaaaa

SEQ ID NO: 326 - DNA, 2532 bp, Equus caballus
  exon (1)..(2532)
atgatgccgcccacccgcctggctgggactctgatcccagccatggccttcctctcctgcctgagacccgagagctgggacccttgcgtgcaggtggttcctaacactacttaccaatgcatggacctgaatctctacaaaatccctgagaacatccccacatcaaccaaggaactggacctgagctttaaccccttgaaggagttaggcagccatagcttctccaacttcccagaactgcaggtgctggatttgtccaggtgtgaaattgagatgattgaagatgatgcatatcagggcctcaaccatctctccaccttgatattgacaggaaatcctatcaggagcttagccctgggagccttttctggactctccagtttacagacgctggtggccgtggagacaaagctttcatctctagagaagttccccattggacatctcaagaccttgaaggagcttaatgtggctcataatcttatccattccttcaagttacccgagtatttttctaaaatgcccaacctggagcacttggacctttccaataacaagatccaaaatatttctcatgaagacttgcgtgtgctacatcaaatgcccttactcaacctttctttagacttgtccctgaatcctttagagtttatccaaccagatgcctttaaagaaattaagctccataaactgactttgagaagtaattttgatagtatagatgtaatgaaatcttgtattcaaggactggctggtttaaaagtcaatcggttggttctgggagaatttaaaaatgaaaggaaattggaaagatttgacacatctgccctgcgcggactgcacaatttgacgattgaagaattccggttagcatacattgataattacagctcaaaggattctattgatttacttaattgtttggcagatatttctaaaatttctctggtgagtctggatttaggcaatctaaaagattttcctaaaggtttcggatggcaagacttcgaattggttaactgtagaattgaaggatttcccacattggagctcacctctctcaaaaggttggttttcacttccaacaaagatatgaaatcttttaatgaagttaagctaccaagccttgagtttctagatctcagcagaaatcgcttgagtttcaagtcctgctgttctgaggctgatttgaagacaaccagactgaagcatttagatctgagcttcaatgatgttatttccatgagttcaaacttcatgggcttagagcaactagaacatctggatttccagcattccactttgaaacaggccagtgattttccagtattcttatccctcaaaaacctccgttatcttgatatttcttacactaacacccgagttgtcttccatggcatctttgatggcttggtcagcctccaagtcttgaaaatggctggcaattcttttaaggacaacttccttccaaatatcttcagagagatgactaacctgaccaccctggacctttctaagtgtaacctggaacaggtgtcccaggaggcattttgcttactccctcgacttcgggtgttaaatatgagtcacaataacctcctgttcttggatatgcttccttacaaacctctccattccctccagattctggattgcagttttaatcgtattgtggccttcaagtggcaagaactgcagcattttccaagtagtctagcttccttaaatcttactcaaaatgactttgcttgtgtttgtgaataccagagttttctgcagtgggtcaaggaccagaggcagctcttggtggaagttgaacacttggtgtgtgcaatacccttacagatgcggggcatgcccgtgctgggttttaacaatgccacctgtcagattagcaagactatcgttggcgggtcggttttcagtatactcatggtttctgtcatagcagttctggtctataagttctatttccacctgatgcttcttgctggctgcaaaaagtatgggagaggtgaaagcatctatgatgcctttgttatctactcaagccaggacgaagactgggtgaggaatgaattggtaaagaacttggaggagggggtgcccccctttcaactctgccttcactacagagacttcattcctggtgtggccatcgccgccaacatcatccaggaaggtttccacaaaagccggaaagttattgtcgtggtgtcccagcacttcattcagagccgatggtgtatctttgagtatgagattgcccagacctggcagtttctgagcagtcgtgctggcatcatcttcatcgtcctgcacaagctggagaagtccctgctccggcagcaggtggagctgtatcgccttctcaacaggaacacttacctggagtgggaggacagtgtcctggggcggcacatcttctggagacgactcaggaaagccttgctggatggtaaaccgtggagtccagcaggaacagcagatgcagcagaaagcagacaacatgatgcagaaacctctacctga

SEQ ID NO: 327 - DNA, 25 bp, Artificial sequence
  Synthetic oligonucleotide sequence
aggacgtgacctacgcccaggtgaa

SEQ ID NO: 328 - DNA, 25 bp, Artificial sequence
  Synthetic oligonucleotide sequence
agggaccccagaagacataggagct

SEQ ID NO: 329 - DNA, 25 bp, Artificial sequence
  Synthetic oligonucleotide sequence
aggtgaaccacttgaccctcagagg

SEQ ID NO: 330 - DNA, 25 bp, Artificial sequence
  Synthetic oligonucleotide sequence
agtggtacgctgctatggccatcca

SEQ ID NO: 331 - DNA, 25 bp, Artificial sequence
  Synthetic oligonucleotide sequence
agcagagcccagtggtacgctgcta

SEQ ID NO: 332 - DNA, 25 bp, Artificial sequence
  Synthetic oligonucleotide sequence
cataggagctgcctccagaggacac

SEQ ID NO: 333 - DNA, 25 bp, Artificial sequence
  Synthetic oligonucleotide sequence
gagactgcagggaccccagaagaca

SEQ ID NO: 334 - DNA, 25 bp, Artificial sequence
  Synthetic oligonucleotide sequence
gatgccaccctccatggagggagac

SEQ ID NO: 335 - DNA, 25 bp, Artificial sequence
  Synthetic oligonucleotide sequence
gtatgcacaggctgctatatctgaa

SEQ ID NO: 336 - DNA, 25 bp, Artificial sequence
  Synthetic oligonucleotide sequence
tggccatccactagcccaggaagga

SEQ ID NO: 337 - DNA, 25 bp, Artificial sequence
  Synthetic oligonucleotide sequence
tagcccaggaaggacccggatgcca

SEQ ID NO: 338 - DNA, 25 bp, Artificial sequence
  Synthetic oligonucleotide sequence
atgctggcaaaacctctaagactgt

SEQ ID NO: 339 - DNA, 25 bp, Artificial sequence
  Synthetic oligonucleotide sequence
agtttcccttctgcagcttgttttt

SEQ ID NO: 340 - DNA, 25 bp, Artificial sequence
  Synthetic oligonucleotide sequence
acctgattctgcctctttaatgaat

SEQ ID NO: 341 - DNA, 25 bp, Artificial sequence
  Synthetic oligonucleotide sequence
acagttcctatgcatggtttttaac

SEQ ID NO: 342 - DNA, 25 bp, Artificial sequence
  Synthetic oligonucleotide sequence
cacgagggaagagggtctccttcca

SEQ ID NO: 343 - DNA, 25 bp, Artificial sequence
  Synthetic oligonucleotide sequence
gcttgttttttctcactatctgtat

SEQ ID NO: 344 - DNA, 25 bp, Artificial sequence
  Synthetic oligonucleotide sequence
gaacaatttaatttcttggccgtgt

SEQ ID NO: 345 - DNA, 25 bp, Artificial sequence
  Synthetic oligonucleotide sequence
ggccgtgtttagtaacagttcctat

SEQ ID NO: 346 - DNA, 25 bp, Artificial sequence
  Synthetic oligonucleotide sequence
gaaagttgatttgtcctagtgcaaa

SEQ ID NO: 347 - DNA, 25 bp, Artificial sequence
  Synthetic oligonucleotide sequence
gaaactcaatgccttatgtgctcac

SEQ ID NO: 348 - DNA, 25 bp, Artificial sequence
  Synthetic oligonucleotide sequence
ttatgtgctcactcagtttcccttc

SEQ ID NO: 349 - DNA, 25 bp, Artificial sequence
  Synthetic oligonucleotide sequence
agaccaccttacagcggcgttatga

SEQ ID NO: 350 - DNA, 25 bp, Artificial sequence
  Synthetic oligonucleotide sequence
agctgaagcttgcacagtgttcacc

SEQ ID NO: 351 - DNA, 25 bp, Artificial sequence
  Synthetic oligonucleotide sequence
acaggctctgacaagggcttccaga

SEQ ID NO: 352 - DNA, 25 bp, Artificial sequence
  Synthetic oligonucleotide sequence
gaatcctgtctccagcagaagctga

SEQ ID NO: 353 - DNA, 25 bp, Artificial sequence
  Synthetic oligonucleotide sequence
gaatgctcagtgtttccctgttcat

SEQ ID NO: 354 - DNA, 25 bp, Artificial sequence
  Synthetic oligonucleotide sequence
gaaccgcagcgaggagtttctcatc

SEQ ID NO: 355 - DNA, 25 bp, Artificial sequence
  Synthetic oligonucleotide sequence
ggacgagaagctgtacatcaccacc

SEQ ID NO: 356 - DNA, 25 bp, Artificial sequence
  Synthetic oligonucleotide sequence
tgagttcgtcatcagggccaagttc

SEQ ID NO: 357 - DNA, 25 bp, Artificial sequence
  Synthetic oligonucleotide sequence
tgcggatacttccacaggtcggaga

SEQ ID NO: 358 - DNA, 25 bp, Artificial sequence
  Synthetic oligonucleotide sequence
tgattgcttgtggacggaccagctc

SEQ ID NO: 359 - DNA, 25 bp, Artificial sequence
  Synthetic oligonucleotide sequence
ttctcatcgccggacaactattgga

SEQ ID NO: 360 - DNA, 25 bp, Artificial sequence
  Synthetic oligonucleotide sequence
gttaaaaggctgacccacgtggctt

SEQ ID NO: 361 - DNA, 25 bp, Artificial sequence
  Synthetic oligonucleotide sequence
agaacacctccatcctgtgataagt

SEQ ID NO: 362 - DNA, 25 bp, Artificial sequence
  Synthetic oligonucleotide sequence
acgtggctttgcagtgctgttcgtc

SEQ ID NO: 363 - DNA, 25 bp, Artificial sequence
  Synthetic oligonucleotide sequence
aaaagtccacacagctctcctgttt

SEQ ID NO: 364 - DNA, 25 bp, Artificial sequence
  Synthetic oligonucleotide sequence
gtctacgttcacagcctcaaaaaag

SEQ ID NO: 365 - DNA, 25 bp, Artificial sequence
  Synthetic oligonucleotide sequence
gctgttcgtccagaagcatggcaca

SEQ ID NO: 366 - DNA, 25 bp, Artificial sequence
  Synthetic oligonucleotide sequence
gaacagagccacaccggtattatat

SEQ ID NO: 367 - DNA, 25 bp, Artificial sequence
  Synthetic oligonucleotide sequence
gttctattgcgtttgctgactaaat

SEQ ID NO: 368 - DNA, 25 bp, Artificial sequence
  Synthetic oligonucleotide sequence
ggtttgtttttacttgagcctgcct

SEQ ID NO: 369 - DNA, 25 bp, Artificial sequence
  Synthetic oligonucleotide sequence
ggattcagctttactcctttgtaac

SEQ ID NO: 370 - DNA, 25 bp, Artificial sequence
  Synthetic oligonucleotide sequence
tgagcctgcctttgtacccttttta

SEQ ID NO: 371 - DNA, 25 bp, Artificial sequence
  Synthetic oligonucleotide sequence
aggatttgcctagagaggcccgttc

SEQ ID NO: 372 - DNA, 25 bp, Artificial sequence
  Synthetic oligonucleotide sequence
tgttacccgagtctgacccagtcct

SEQ ID NO: 373 - DNA, 25 bp, Artificial sequence
  Synthetic oligonucleotide sequence
gaatgacttaggaggccccaggaaa

SEQ ID NO: 374 - DNA, 25 bp, Artificial sequence
  Synthetic oligonucleotide sequence
atcactggattggatgctgagccta

SEQ ID NO: 375 - DNA, 25 bp, Artificial sequence
  Synthetic oligonucleotide sequence
agtcctgggttagctgccgccatat

SEQ ID NO: 376 - DNA, 25 bp, Artificial sequence
  Synthetic oligonucleotide sequence
agagcttcatctagctggcaccaga

SEQ ID NO: 377 - DNA, 25 bp, Artificial sequence
  Synthetic oligonucleotide sequence
gctgccgccatatcactggattgga

SEQ ID NO: 378 - DNA, 25 bp, Artificial sequence
  Synthetic oligonucleotide sequence
gatgctgagcctagaaactgatcaa

SEQ ID NO: 379 - DNA, 25 bp, Artificial sequence
  Synthetic oligonucleotide sequence
gttccttcaacagagcttcatctag

SEQ ID NO: 380 - DNA, 25 bp, Artificial sequence
  Synthetic oligonucleotide sequence
tggcaccagaggcaggattgcacct

SEQ ID NO: 381 - DNA, 25 bp, Artificial sequence
  Synthetic oligonucleotide sequence
ttgcacctgtggtgggtgcttagcc

SEQ ID NO: 382 - DNA, 25 bp, Artificial sequence
  Synthetic oligonucleotide sequence
agggagtgggtcacagcccatgacc

SEQ ID NO: 383 - DNA, 25 bp, Artificial sequence
  Synthetic oligonucleotide sequence
atgggatccccagagtggacctgcc

SEQ ID NO: 384 - DNA, 25 bp, Artificial sequence
  Synthetic oligonucleotide sequence
atggagagcgttgctggcagccata

SEQ ID NO: 385 - DNA, 25 bp, Artificial sequence
  Synthetic oligonucleotide sequence
agtgacagtttgctgtcaggtcccc

SEQ ID NO: 386 - DNA, 25 bp, Artificial sequence
  Synthetic oligonucleotide sequence
agaccttgggtcgagtaacgcttgt

SEQ ID NO: 387 - DNA, 25 bp, Artificial sequence
  Synthetic oligonucleotide sequence
acgttttgcctgcacatggctcaga

SEQ ID NO: 388 - DNA, 25 bp, Artificial sequence
  Synthetic oligonucleotide sequence
gccagtttgtgcacccatggagagc

SEQ ID NO: 389 - DNA, 25 bp, Artificial sequence
  Synthetic oligonucleotide sequence
gaaattgtgattagccggtagtgac

SEQ ID NO: 390 - DNA, 25 bp, Artificial sequence
  Synthetic oligonucleotide sequence
gagtaacgcttgtttgtgtgtatct

SEQ ID NO: 391 - DNA, 25 bp, Artificial sequence
  Synthetic oligonucleotide sequence
ggcattccagacagctgacccggca

SEQ ID NO: 392 - DNA, 25 bp, Artificial sequence
  Synthetic oligonucleotide sequence
tgggcctcctcttaggcatgggatc

SEQ ID NO: 393 - DNA, 25 bp, Artificial sequence
  Synthetic oligonucleotide sequence
agactttcccaggttcgggagctgc

SEQ ID NO: 394 - DNA, 25 bp, Artificial sequence
  Synthetic oligonucleotide sequence
aagtggaggctctagctgactgcct

SEQ ID NO: 395 - DNA, 25 bp, Artificial sequence
  Synthetic oligonucleotide sequence
ctcagagctgcccaagtggaggctc

SEQ ID NO: 396 - DNA, 25 bp, Artificial sequence
  Synthetic oligonucleotide sequence
ccgactccagcagcacgtagaagtg

SEQ ID NO: 397 - DNA, 25 bp, Artificial sequence
  Synthetic oligonucleotide sequence
gccgtgagctgccatgtgcttctca

SEQ ID NO: 398 - DNA, 25 bp, Artificial sequence
  Synthetic oligonucleotide sequence
gctgctgtgtccagaggtggcattt

SEQ ID NO: 399 - DNA, 25 bp, Artificial sequence
  Synthetic oligonucleotide sequence
gtaagcgcgaggaaatcctttttat

SEQ ID NO: 400 - DNA, 25 bp, Artificial sequence
  Synthetic oligonucleotide sequence
ggcatttgactatttttgaccagga

SEQ ID NO: 401 - DNA, 25 bp, Artificial sequence
  Synthetic oligonucleotide sequence
ggctgctgggtctgttgtcagtcct

SEQ ID NO: 402 - DNA, 25 bp, Artificial sequence
  Synthetic oligonucleotide sequence
tgtcagtcctgctgctaacctggca

SEQ ID NO: 403 - DNA, 25 bp, Artificial sequence
  Synthetic oligonucleotide sequence
ttttattgtattatcttccctccct

SEQ ID NO: 404 - DNA, 25 bp, Artificial sequence
  Synthetic oligonucleotide sequence
accacttcatgttctctacagagct

SEQ ID NO: 405 - DNA, 25 bp, Artificial sequence
  Synthetic oligonucleotide sequence
acagagctgtccagagccgaggctg

SEQ ID NO: 406 - DNA, 25 bp, Artificial sequence
  Synthetic oligonucleotide sequence
aaacgagtccgagggcacagccagg

SEQ ID NO: 407 - DNA, 25 bp, Artificial sequence
  Synthetic oligonucleotide sequence
cgttgcccgctgttggtcatgacaa

SEQ ID NO: 408 - DNA, 25 bp, Artificial sequence
  Synthetic oligonucleotide sequence
gagtctctgtcaggatccttttgaa

SEQ ID NO: 409 - DNA, 25 bp, Artificial sequence
  Synthetic oligonucleotide sequence
gagtcacccaaggaacttatgcaga

SEQ ID NO: 410 - DNA, 25 bp, Artificial sequence
  Synthetic oligonucleotide sequence
gtcctgtggcttttgtgtgtctctc

SEQ ID NO: 411 - DNA, 25 bp, Artificial sequence
  Synthetic oligonucleotide sequence
ggccttgcttgagagaggtccatcc

SEQ ID NO: 412 - DNA, 25 bp, Artificial sequence
  Synthetic oligonucleotide sequence
ggtcacttagcagcgacttcttgga

SEQ ID NO: 413 - DNA, 25 bp, Artificial sequence
  Synthetic oligonucleotide sequence
ggagccaggtgtctgcatttgaaca

SEQ ID NO: 414 - DNA, 25 bp, Artificial sequence
  Synthetic oligonucleotide sequence
ttatgcagatgccatgtcctcactc

SEQ ID NO: 415 - DNA, 25 bp, Artificial sequence
  Synthetic oligonucleotide sequence
atttgccgcaagtgttatgctcgcc

SEQ ID NO: 416 - DNA, 25 bp, Artificial sequence
  Synthetic oligonucleotide sequence
atctttgtgaagaccctgacgggca

SEQ ID NO: 417 - DNA, 25 bp, Artificial sequence
  Synthetic oligonucleotide sequence
aacctgcgccccaagaagaaggtca

SEQ ID NO: 418 - DNA, 25 bp, Artificial sequence
  Synthetic oligonucleotide sequence
agcagcgtttgatttttgccggcaa

SEQ ID NO: 419 - DNA, 25 bp, Artificial sequence
  Synthetic oligonucleotide sequence
gaaggtcaaataaggcccctcctct

SEQ ID NO: 420 - DNA, 25 bp, Artificial sequence
  Synthetic oligonucleotide sequence
cactctctcagactacaatatccag

SEQ ID NO: 421 - DNA, 25 bp, Artificial sequence
  Synthetic oligonucleotide sequence
gcaagaagaagtgcggccacaccaa

SEQ ID NO: 422 - DNA, 25 bp, Artificial sequence
  Synthetic oligonucleotide sequence
gacgcagacatgcagatctttgtga

SEQ ID NO: 423 - DNA, 25 bp, Artificial sequence
  Synthetic oligonucleotide sequence
ggttgagcccagtgacaccattgag

SEQ ID NO: 424 - DNA, 25 bp, Artificial sequence
  Synthetic oligonucleotide sequence
tcgtgctgtcaactgccgcaagaag

SEQ ID NO: 425 - DNA, 25 bp, Artificial sequence
  Synthetic oligonucleotide sequence
ttttgccggcaaacagctggaggac

SEQ ID NO: 426 - DNA, 25 bp, Artificial sequence
  Synthetic oligonucleotide sequence
agtcatctcttattcttcatctttg

SEQ ID NO: 427 - DNA, 25 bp, Artificial sequence
  Synthetic oligonucleotide sequence
acaggatgacctcttgacactcaaa

SEQ ID NO: 428 - DNA, 25 bp, Artificial sequence
  Synthetic oligonucleotide sequence
aataaaggccgcttgtctgctttgc

SEQ ID NO: 429 - DNA, 25 bp, Artificial sequence
  Synthetic oligonucleotide sequence
gaaaaccctctgaagtacctgtatc

SEQ ID NO: 430 - DNA, 25 bp, Artificial sequence
  Synthetic oligonucleotide sequence
gagagaaaacctgagtcccacgacc

SEQ ID NO: 431 - DNA, 25 bp, Artificial sequence
  Synthetic oligonucleotide sequence
tggcatgacactcccaattgggtgt

SEQ ID NO: 432 - DNA, 25 bp, Artificial sequence
  Synthetic oligonucleotide sequence
gatgaagtctccatattctgccgaa

SEQ ID NO: 433 - DNA, 25 bp, Artificial sequence
  Synthetic oligonucleotide sequence
ggttgaagtctgaagctctgctctc

SEQ ID NO: 434 - DNA, 25 bp, Artificial sequence
  Synthetic oligonucleotide sequence
tgatctttgccaacagtcatctctt

SEQ ID NO: 435 - DNA, 25 bp, Artificial sequence
  Synthetic oligonucleotide sequence
tatgttccttctgtttttatcccca

SEQ ID NO: 436 - DNA, 25 bp, Artificial sequence
  Synthetic oligonucleotide sequence
tttgctgacatccttcgagactaca

SEQ ID NO: 437 - DNA, 25 bp, Artificial sequence
  Synthetic oligonucleotide sequence
atgtttgctccaacacagaggacag

SEQ ID NO: 438 - DNA, 25 bp, Artificial sequence
  Synthetic oligonucleotide sequence
acatcagacatcatcacccgaattg

SEQ ID NO: 439 - DNA, 25 bp, Artificial sequence
  Synthetic oligonucleotide sequence
aaggctgcagcctatgatatcagtg

SEQ ID NO: 440 - DNA, 25 bp, Artificial sequence
  Synthetic oligonucleotide sequence
catcacctccagaagctctttgttg

SEQ ID NO: 441 - DNA, 25 bp, Artificial sequence
  Synthetic oligonucleotide sequence
gaaataccacttgcaggagcgagtt

SEQ ID NO: 442 - DNA, 25 bp, Artificial sequence
  Synthetic oligonucleotide sequence
gacagaaggtatctccacatcagac

SEQ ID NO: 443 - DNA, 25 bp, Artificial sequence
  Synthetic oligonucleotide sequence
gatggcctttctctggcaagacttc

SEQ ID NO: 444 - DNA, 25 bp, Artificial sequence
  Synthetic oligonucleotide sequence
gatgctgcaggccatcagtccaaag

SEQ ID NO: 445 - DNA, 25 bp, Artificial sequence
  Synthetic oligonucleotide sequence
gtccgggactatgatgtgtacgcga

SEQ ID NO: 446 - DNA, 25 bp, Artificial sequence
  Synthetic oligonucleotide sequence
gggctacacagccaaggagctcaat

SEQ ID NO: 447 - DNA, 25 bp, Artificial sequence
  Synthetic oligonucleotide sequence
tcagtccaaagcagagtcccagcag

SEQ ID NO: 448 - DNA, 25 bp, Artificial sequence
  Synthetic oligonucleotide sequence
actggtattctcagcttcgtatgct

SEQ ID NO: 449 - DNA, 25 bp, Artificial sequence
  Synthetic oligonucleotide sequence
aaggatcctccttctggacttgttt

SEQ ID NO: 450 - DNA, 25 bp, Artificial sequence
  Synthetic oligonucleotide sequence
cagcgagatcagcaaggccttttct

SEQ ID NO: 451 - DNA, 25 bp, Artificial sequence
  Synthetic oligonucleotide sequence
caatgtgcatgtttcagaccttctg

SEQ ID NO: 452 - DNA, 25 bp, Artificial sequence
  Synthetic oligonucleotide sequence
gcttgccactgcctttgggatatag

SEQ ID NO: 453 - DNA, 25 bp, Artificial sequence
  Synthetic oligonucleotide sequence
taatgggtcccttcagtcagtggca

SEQ ID NO: 454 - DNA, 25 bp, Artificial sequence
  Synthetic oligonucleotide sequence
gtgacttttggttacctgggcacac

SEQ ID NO: 455 - DNA, 25 bp, Artificial sequence
  Synthetic oligonucleotide sequence
ggtagtgttggatctcagccaccca

SEQ ID NO: 456 - DNA, 25 bp, Artificial sequence
  Synthetic oligonucleotide sequence
tcgtatgctgcagtacctgtggaca

SEQ ID NO: 457 - DNA, 25 bp, Artificial sequence
  Synthetic oligonucleotide sequence
tatagggactgcagcctttgtttct

SEQ ID NO: 458 - DNA, 25 bp, Artificial sequence
  Synthetic oligonucleotide sequence
ttctgctctctctggaatgggtagt

SEQ ID NO: 459 - DNA, 25 bp, Artificial sequence
  Synthetic oligonucleotide sequence
acgacgtcttccagtaccgagagaa

SEQ ID NO: 460 - DNA, 25 bp, Artificial sequence
  Synthetic oligonucleotide sequence
actggcgcgtgagttcccggaatga

SEQ ID NO: 461 - DNA, 25 bp, Artificial sequence
  Synthetic oligonucleotide sequence
aagtgggctacgtgagcttcgacct

SEQ ID NO: 462 - DNA, 25 bp, Artificial sequence
  Synthetic oligonucleotide sequence
gctggattccgcctttgaggagcca

SEQ ID NO: 463 - DNA, 25 bp, Artificial sequence
  Synthetic oligonucleotide sequence
gaaggagccagtttgccggtttcaa

SEQ ID NO: 464 - DNA, 25 bp, Artificial sequence
  Synthetic oligonucleotide sequence
gaagattttcttcttctctgggcgc

SEQ ID NO: 465 - DNA, 25 bp, Artificial sequence
  Synthetic oligonucleotide sequence
gaggagccactcaccaagaagattt

SEQ ID NO: 466 - DNA, 25 bp, Artificial sequence
  Synthetic oligonucleotide sequence
gtgtcagcccggtggaccagatgtt

SEQ ID NO: 467 - DNA, 25 bp, Artificial sequence
  Synthetic oligonucleotide sequence
gtgtacacaggcaagtcggcgctag

SEQ ID NO: 468 - DNA, 25 bp, Artificial sequence
  Synthetic oligonucleotide sequence
ggtttcaaactggtgggtctgttct

SEQ ID NO: 469 - DNA, 25 bp, Artificial sequence
  Synthetic oligonucleotide sequence
taggcccgaggcgtctggacaagct

SEQ ID NO: 470 - DNA, 25 bp, Artificial sequence
  Synthetic oligonucleotide sequence
agggcagcaagcagagcctgaccaa

SEQ ID NO: 471 - DNA, 25 bp, Artificial sequence
  Synthetic oligonucleotide sequence
aaagctcttgttggcagtcgtttcc

SEQ ID NO: 472 - DNA, 25 bp, Artificial sequence
  Synthetic oligonucleotide sequence
gccgaggtggacttcagcgagttca

SEQ ID NO: 473 - DNA, 25 bp, Artificial sequence
  Synthetic oligonucleotide sequence
cctggcgtccagaaagctcttgttg

SEQ ID NO: 474 - DNA, 25 bp, Artificial sequence
  Synthetic oligonucleotide sequence
gagcatgatcatcgacgtctttgcc

SEQ ID NO: 475 - DNA, 25 bp, Artificial sequence
  Synthetic oligonucleotide sequence
gagttcatcgtgtttgtggccgcgc

SEQ ID NO: 476 - DNA, 25 bp, Artificial sequence
  Synthetic oligonucleotide sequence
gaggtgggacatttcctcggccacg

SEQ ID NO: 477 - DNA, 25 bp, Artificial sequence
  Synthetic oligonucleotide sequence
gtgggtccaaatccagcaccatgac

SEQ ID NO: 478 - DNA, 25 bp, Artificial sequence
  Synthetic oligonucleotide sequence
ggtgccgtggacaaactgctcaagg

SEQ ID NO: 479 - DNA, 25 bp, Artificial sequence
  Synthetic oligonucleotide sequence
tcatggagaaggagctcccgggctt

SEQ ID NO: 480 - DNA, 25 bp, Artificial sequence
  Synthetic oligonucleotide sequence
tcaaggacctggacgccaacggaga

SEQ ID NO: 481 - DNA, 25 bp, Artificial sequence
  Synthetic oligonucleotide sequence
atgattaacaaagccacctttccct

SEQ ID NO: 482 - DNA, 25 bp, Artificial sequence
  Synthetic oligonucleotide sequence
attgttcacgcagttaatcacccac

SEQ ID NO: 483 - DNA, 25 bp, Artificial sequence
  Synthetic oligonucleotide sequence
atctctgtgattctgttcctcaaca

SEQ ID NO: 484 - DNA, 25 bp, Artificial sequence
  Synthetic oligonucleotide sequence
atgcacctccgtcagtatgagctgc

SEQ ID NO: 485 - DNA, 25 bp, Artificial sequence
  Synthetic oligonucleotide sequence
ctgctcgctgagaaagtccttgctg

SEQ ID NO: 486 - DNA, 25 bp, Artificial sequence
  Synthetic oligonucleotide sequence
gctcccttcagcttggttaaatata

SEQ ID NO: 487 - DNA, 25 bp, Artificial sequence
  Synthetic oligonucleotide sequence
gaatttctgagaatcagccccgcta

SEQ ID NO: 488 - DNA, 25 bp, Artificial sequence
  Synthetic oligonucleotide sequence
gactactttccagaatttgctcgct

SEQ ID NO: 489 - DNA, 25 bp, Artificial sequence
  Synthetic oligonucleotide sequence
gttccctctctctttcagtaagtaa

SEQ ID NO: 490 - DNA, 25 bp, Artificial sequence
  Synthetic oligonucleotide sequence
ggccaagtacttcatccgtgacgaa

SEQ ID NO: 491 - DNA, 25 bp, Artificial sequence
  Synthetic oligonucleotide sequence
tcgctacactactcctgaggatgct

SEQ ID NO: 492 - DNA, 25 bp, Artificial sequence
  Synthetic oligonucleotide sequence
aagggcagctccgactgaccagagg

SEQ ID NO: 493 - DNA, 25 bp, Artificial sequence
  Synthetic oligonucleotide sequence
gctgtagctgaagtaggccctgccc

SEQ ID NO: 494 - DNA, 25 bp, Artificial sequence
  Synthetic oligonucleotide sequence
gcagctccgactgaccagaggaaga

SEQ ID NO: 495 - DNA, 25 bp, Artificial sequence
  Synthetic oligonucleotide sequence
gaagtaggccctgcccttacaggaa

SEQ ID NO: 496 - DNA, 25 bp, Artificial sequence
  Synthetic oligonucleotide sequence
gaagctgatcagtggctgtagctga

SEQ ID NO: 497 - DNA, 25 bp, Artificial sequence
  Synthetic oligonucleotide sequence
gactgaccagaggaagaagctgatc

SEQ ID NO: 498 - DNA, 25 bp, Artificial sequence
  Synthetic oligonucleotide sequence
gatgctaaacaagggcagctccgac

SEQ ID NO: 499 - DNA, 25 bp, Artificial sequence
  Synthetic oligonucleotide sequence
ggaagtttgtctcaaccctgaagcc

SEQ ID NO: 500 - DNA, 25 bp, Artificial sequence
  Synthetic oligonucleotide sequence
ggccctgcccttacaggaatcaaag

SEQ ID NO: 501 - DNA, 25 bp, Artificial sequence
  Synthetic oligonucleotide sequence
tggacaggaagtttgtctcaaccct

SEQ ID NO: 502 - DNA, 25 bp, Artificial sequence
  Synthetic oligonucleotide sequence
taaacaagggcagctccgactgacc

SEQ ID NO: 503 - DNA, 25 bp, Artificial sequence
  Synthetic oligonucleotide sequence
atgcttgccatgctgatgccagagg

SEQ ID NO: 504 - DNA, 25 bp, Artificial sequence
  Synthetic oligonucleotide sequence
atctagcccgcctaggtgtacaaga

SEQ ID NO: 505 - DNA, 25 bp, Artificial sequence
  Synthetic oligonucleotide sequence
cattcattttcttcattcggcacaa

SEQ ID NO: 506 - DNA, 25 bp, Artificial sequence
  Synthetic oligonucleotide sequence
gctaacatcctgttcttaggcagat

SEQ ID NO: 507 - DNA, 25 bp, Artificial sequence
  Synthetic oligonucleotide sequence
gcaaagctgatctgtctggcatgtc

SEQ ID NO: 508 - DNA, 25 bp, Artificial sequence
  Synthetic oligonucleotide sequence
gaatctgtatctcgctgaagtcaat

SEQ ID NO: 509 - DNA, 25 bp, Artificial sequence
  Synthetic oligonucleotide sequence
gaaaatttcaatgccgaccatccat

SEQ ID NO: 510 - DNA, 25 bp, Artificial sequence
  Synthetic oligonucleotide sequence
gggccagagatcttttcgtatcgaa

SEQ ID NO: 511 - DNA, 25 bp, Artificial sequence
  Synthetic oligonucleotide sequence
tgaagtcaatgtccacttgcccagg

SEQ ID NO: 512 - DNA, 25 bp, Artificial sequence
  Synthetic oligonucleotide sequence
tttggcgtgggtagctattttcctt

SEQ ID NO: 513 - DNA, 25 bp, Artificial sequence
  Synthetic oligonucleotide sequence
ttaggcagattttcttccccttaga

SEQ ID NO: 514 - DNA, 25 bp, Artificial sequence
  Synthetic oligonucleotide sequence
aggagcctccggagtccagcggcct

SEQ ID NO: 515 - DNA, 25 bp, Artificial sequence
  Synthetic oligonucleotide sequence
agctttttaactagcctggagcctt

SEQ ID NO: 516 - DNA, 25 bp, Artificial sequence
  Synthetic oligonucleotide sequence
cgtcagagcttctgcctgagcctct

SEQ ID NO: 517 - DNA, 25 bp, Artificial sequence
  Synthetic oligonucleotide sequence
ctgcagccactagagatagcttttt

SEQ ID NO: 518 - DNA, 25 bp, Artificial sequence
  Synthetic oligonucleotide sequence
ctccggagtccagcggcctttgagg

SEQ ID NO: 519 - DNA, 25 bp, Artificial sequence
  Synthetic oligonucleotide sequence
ctggcgtcagagcttctgcctgagc

SEQ ID NO: 520 - DNA, 25 bp, Artificial sequence
  Synthetic oligonucleotide sequence
gagatagctttttaactagcctgga

SEQ ID NO: 521 - DNA, 25 bp, Artificial sequence
  Synthetic oligonucleotide sequence
tttggtatccccctggcgtcagagc

SEQ ID NO: 522 - DNA, 25 bp, Artificial sequence
  Synthetic oligonucleotide sequence
tccctgcagccactagagatagctt

SEQ ID NO: 523 - DNA, 25 bp, Artificial sequence
  Synthetic oligonucleotide sequence
ttttaactagcctggagccttctgc

SEQ ID NO: 524 - DNA, 25 bp, Artificial sequence
  Synthetic oligonucleotide sequence
taactagcctggagccttctgccca

SEQ ID NO: 525 - DNA, 25 bp, Artificial sequence
  Synthetic oligonucleotide sequence
atttgctgaccttgtggtgctctca

SEQ ID NO: 526 - DNA, 25 bp, Artificial sequence
  Synthetic oligonucleotide sequence
aagttgtcacgtgcagtgtctttct

SEQ ID NO: 527 - DNA, 25 bp, Artificial sequence
  Synthetic oligonucleotide sequence
aagggcaatcctgcttcactggtgt

SEQ ID NO: 528 - DNA, 25 bp, Artificial sequence
  Synthetic oligonucleotide sequence
gctggtgcccctgtaaagaggcttt

SEQ ID NO: 529 - DNA, 25 bp, Artificial sequence
  Synthetic oligonucleotide sequence
gaagttgtcaccatgaagttgtcac

SEQ ID NO: 530 - DNA, 25 bp, Artificial sequence
  Synthetic oligonucleotide sequence
gagcgtttcctttacctggaagttg

SEQ ID NO: 531 - DNA, 25 bp, Artificial sequence
  Synthetic oligonucleotide sequence
gagacctgttgtgctgtgttatttt

SEQ ID NO: 532 - DNA, 25 bp, Artificial sequence
  Synthetic oligonucleotide sequence
gatggctgttttcctgtcccagaga

SEQ ID NO: 533 - DNA, 25 bp, Artificial sequence
  Synthetic oligonucleotide sequence
gatgtctgaccttagtgttccaaac

SEQ ID NO: 534 - DNA, 25 bp, Artificial sequence
  Synthetic oligonucleotide sequence
gttaagtatgtggttccttctcaga

SEQ ID NO: 535 - DNA, 25 bp, Artificial sequence
  Synthetic oligonucleotide sequence
taaaggatgtcctggtgctggctca

SEQ ID NO: 536 - DNA, 25 bp, Artificial sequence
  Synthetic oligonucleotide sequence
cgaaccccggaagtctgcaaaattg

SEQ ID NO: 537 - DNA, 25 bp, Artificial sequence
  Synthetic oligonucleotide sequence
aggatgactcgggtccagtggccca

SEQ ID NO: 538 - DNA, 25 bp, Artificial sequence
  Synthetic oligonucleotide sequence
aagtctgcaaaattgggtgccccaa

SEQ ID NO: 539 - DNA, 25 bp, Artificial sequence
  Synthetic oligonucleotide sequence
ctgctctctgctccctaaattattg

SEQ ID NO: 540 - DNA, 25 bp, Artificial sequence
  Synthetic oligonucleotide sequence
ccagaatctgcccacggagtcggtg

SEQ ID NO: 541 - DNA, 25 bp, Artificial sequence
  Synthetic oligonucleotide sequence
ccccggtttcatatctgtatttata

SEQ ID NO: 542 - DNA, 25 bp, Artificial sequence
  Synthetic oligonucleotide sequence
gggtgccccaagagctggaaactca

SEQ ID NO: 543 - DNA, 25 bp, Artificial sequence
  Synthetic oligonucleotide sequence
gaggcctcagtgcagtgccttcccg

SEQ ID NO: 544 - DNA, 25 bp, Artificial sequence
  Synthetic oligonucleotide sequence
gtgcgcaggtcccactcaggatgac

SEQ ID NO: 545 - DNA, 25 bp, Artificial sequence
  Synthetic oligonucleotide sequence
ggaaactcaggaaaccccaggtgct

SEQ ID NO: 546 - DNA, 25 bp, Artificial sequence
  Synthetic oligonucleotide sequence
ttaatatatgcaattccccatccct

SEQ ID NO: 547 - DNA, 25 bp, Artificial sequence
  Synthetic oligonucleotide sequence
tacttcttaggtacctgaacggcct

SEQ ID NO: 548 - DNA, 25 bp, Artificial sequence
  Synthetic oligonucleotide sequence
atttgagttgcttacctactgtagt

SEQ ID NO: 549 - DNA, 25 bp, Artificial sequence
  Synthetic oligonucleotide sequence
agtgtgtctaggttaggctgtttca

SEQ ID NO: 550 - DNA, 25 bp, Artificial sequence
  Synthetic oligonucleotide sequence
aaagcatttcctgtcttgtttgaga

SEQ ID NO: 551 - DNA, 25 bp, Artificial sequence
  Synthetic oligonucleotide sequence
gcttgttacagttcattttctctaa

SEQ ID NO: 552 - DNA, 25 bp, Artificial sequence
  Synthetic oligonucleotide sequence
gacaggcaggcccattaatttgagt

SEQ ID NO: 553 - DNA, 25 bp, Artificial sequence
  Synthetic oligonucleotide sequence
gatggtgggccttcagacagagtac

SEQ ID NO: 554 - DNA, 25 bp, Artificial sequence
  Synthetic oligonucleotide sequence
gatgaggccgagcaactctgtccaa

SEQ ID NO: 555 - DNA, 25 bp, Artificial sequence
  Synthetic oligonucleotide sequence
ggaaaccgcaaggtagtcccagaat

SEQ ID NO: 556 - DNA, 25 bp, Artificial sequence
  Synthetic oligonucleotide sequence
taatgttatggttccctttctgtaa

SEQ ID NO: 557 - DNA, 25 bp, Artificial sequence
  Synthetic oligonucleotide sequence
ttgccactgtacacgtgatctgtga

SEQ ID NO: 558 - DNA, 25 bp, Artificial sequence
  Synthetic oligonucleotide sequence
agatagccttccttcagggtttaat

SEQ ID NO: 559 - DNA, 25 bp, Artificial sequence
  Synthetic oligonucleotide sequence
aaaggcgctctctttctagaggtgc

SEQ ID NO: 560 - DNA, 25 bp, Artificial sequence
  Synthetic oligonucleotide sequence
aaagccttgctttagtttcacttca

SEQ ID NO: 561 - DNA, 25 bp, Artificial sequence
  Synthetic oligonucleotide sequence
aattgaccctaaatctgcagacagt

SEQ ID NO: 562 - DNA, 25 bp, Artificial sequence
  Synthetic oligonucleotide sequence
cagggacatccacgcaactacaaag

SEQ ID NO: 563 - DNA, 25 bp, Artificial sequence
  Synthetic oligonucleotide sequence
gaatgcacactttttctacctgtac

SEQ ID NO: 564 - DNA, 25 bp, Artificial sequence
  Synthetic oligonucleotide sequence
gaagaagccctttgtttctcttgct

SEQ ID NO: 565 - DNA, 25 bp, Artificial sequence
  Synthetic oligonucleotide sequence
gacatttctgcaacttgggttcctt

SEQ ID NO: 566 - DNA, 25 bp, Artificial sequence
  Synthetic oligonucleotide sequence
gtaagcgcgtcttcctagaattcaa

SEQ ID NO: 567 - DNA, 25 bp, Artificial sequence
  Synthetic oligonucleotide sequence
taactaggtttctgctccattggtg

SEQ ID NO: 568 - DNA, 25 bp, Artificial sequence
  Synthetic oligonucleotide sequence
tacctgtacatatttcttgcgtttg

SEQ ID NO: 569 - DNA, 25 bp, Artificial sequence
  Synthetic oligonucleotide sequence
atccctctggtgtgagccaggatgg

SEQ ID NO: 570 - DNA, 25 bp, Artificial sequence
  Synthetic oligonucleotide sequence
aagaatattctttccttcctgaagg

SEQ ID NO: 571 - DNA, 25 bp, Artificial sequence
  Synthetic oligonucleotide sequence
cacccacaccttctgatgcaaagga

SEQ ID NO: 572 - DNA, 25 bp, Artificial sequence
  Synthetic oligonucleotide sequence
cagccttgtgccttttaagcatgat

SEQ ID NO: 573 - DNA, 25 bp, Artificial sequence
  Synthetic oligonucleotide sequence
cattggtggaagtcctgccctggag

SEQ ID NO: 574 - DNA, 25 bp, Artificial sequence
  Synthetic oligonucleotide sequence
ccccgtgctgtgtccagaaatctaa

SEQ ID NO: 575 - DNA, 25 bp, Artificial sequence
  Synthetic oligonucleotide sequence
gcagcctggccattggtggaagtcc

SEQ ID NO: 576 - DNA, 25 bp, Artificial sequence
  Synthetic oligonucleotide sequence
gaagaattccaccaagcaacaagcc

SEQ ID NO: 577 - DNA, 25 bp, Artificial sequence
  Synthetic oligonucleotide sequence
gatgcaaaggatcaccagccttgtg

SEQ ID NO: 578 - DNA, 25 bp, Artificial sequence
  Synthetic oligonucleotide sequence
ttccttcctgaagggctacttttca

SEQ ID NO: 579 - DNA, 25 bp, Artificial sequence
  Synthetic oligonucleotide sequence
ttaactgactcaaacccacgtggac

SEQ ID NO: 580 - DNA, 25 bp, Artificial sequence
  Synthetic oligonucleotide sequence
gtactacagtacagccagaaggacc

SEQ ID NO: 581 - DNA, 25 bp, Artificial sequence
  Synthetic oligonucleotide sequence
agcagtccttatacctcaagttcga

SEQ ID NO: 582 - DNA, 25 bp, Artificial sequence
  Synthetic oligonucleotide sequence
aagttcgacccgctcctgatggaca

SEQ ID NO: 583 - DNA, 25 bp, Artificial sequence
  Synthetic oligonucleotide sequence
aagagaacctgtcgctcaggagcga

SEQ ID NO: 584 - DNA, 25 bp, Artificial sequence
  Synthetic oligonucleotide sequence
ggacccatcgtggacgtactacagt

SEQ ID NO: 585 - DNA, 25 bp, Artificial sequence
  Synthetic oligonucleotide sequence
gtggaacttgacttcctaggccctc

SEQ ID NO: 586 - DNA, 25 bp, Artificial sequence
  Synthetic oligonucleotide sequence
tggacccacctttgtgtgtcctcgg

SEQ ID NO: 587 - DNA, 25 bp, Artificial sequence
  Synthetic oligonucleotide sequence
tgatggacagccctcagagacctgc

SEQ ID NO: 588 - DNA, 25 bp, Artificial sequence
  Synthetic oligonucleotide sequence
tccggatgtgcctgtgctggaccca

SEQ ID NO: 589 - DNA, 25 bp, Artificial sequence
  Synthetic oligonucleotide sequence
tgccgccaatctcgtggaacttgac

SEQ ID NO: 590 - DNA, 25 bp, Artificial sequence
  Synthetic oligonucleotide sequence
tccccgcgacagacagtgtgcagga

SEQ ID NO: 591 - DNA, 25 bp, Artificial sequence
  Synthetic oligonucleotide sequence
acatgcattcttcctcagtggacca

SEQ ID NO: 592 - DNA, 25 bp, Artificial sequence
  Synthetic oligonucleotide sequence
aaagaacagcccttattcactctac

SEQ ID NO: 593 - DNA, 25 bp, Artificial sequence
  Synthetic oligonucleotide sequence
ctgatgtcaataccacccggatgtg

SEQ ID NO: 594 - DNA, 25 bp, Artificial sequence
  Synthetic oligonucleotide sequence
cagcctgctagttatgtttcatgaa

SEQ ID NO: 595 - DNA, 25 bp, Artificial sequence
  Synthetic oligonucleotide sequence
cacgttttctgcatttgtgggctgc

SEQ ID NO: 596 - DNA, 25 bp, Artificial sequence
  Synthetic oligonucleotide sequence
tctgcaacatcctcaccattaaaaa

SEQ ID NO: 597 - DNA, 25 bp, Artificial sequence
  Synthetic oligonucleotide sequence
gtggcctcatttgctgtatcattac

SEQ ID NO: 598 - DNA, 25 bp, Artificial sequence
  Synthetic oligonucleotide sequence
tggcaaccactttaggcagcaactg

SEQ ID NO: 599 - DNA, 25 bp, Artificial sequence
  Synthetic oligonucleotide sequence
tgtggacctttgctacctgtattaa

SEQ ID NO: 600 - DNA, 25 bp, Artificial sequence
  Synthetic oligonucleotide sequence
ttcaagctttcgtcagtggcaacca

SEQ ID NO: 601 - DNA, 25 bp, Artificial sequence
  Synthetic oligonucleotide sequence
ttattcactctacggcaggttggga

SEQ ID NO: 602 - DNA, 25 bp, Artificial sequence
  Synthetic oligonucleotide sequence
ataacctgttattctgactagctta

SEQ ID NO: 603 - DNA, 25 bp, Artificial sequence
  Synthetic oligonucleotide sequence
atgttcattacccttgtaccatgta

SEQ ID NO: 604 - DNA, 25 bp, Artificial sequence
  Synthetic oligonucleotide sequence
agtgccttactgactgtagccatta

SEQ ID NO: 605 - DNA, 25 bp, Artificial sequence
  Synthetic oligonucleotide sequence
gagtcaatgttattctctcacaatg

SEQ ID NO: 606 - DNA, 25 bp, Artificial sequence
  Synthetic oligonucleotide sequence
gatctctctctctcagttacagttt

SEQ ID NO: 607 - DNA, 25 bp, Artificial sequence
  Synthetic oligonucleotide sequence
gttcttactggccaactcttaaatc

SEQ ID NO: 608 - DNA, 25 bp, Artificial sequence
  Synthetic oligonucleotide sequence
gtttctcatcttggacttcttttat

SEQ ID NO: 609 - DNA, 25 bp, Artificial sequence
  Synthetic oligonucleotide sequence
gtgtgatgccatatcgagtcaatgt

SEQ ID NO: 610 - DNA, 25 bp, Artificial sequence
  Synthetic oligonucleotide sequence
tgtaccatgtacctcagatctctct

SEQ ID NO: 611 - DNA, 25 bp, Artificial sequence
  Synthetic oligonucleotide sequence
tcactgggccattggattttttcca

SEQ ID NO: 612 - DNA, 25 bp, Artificial sequence
  Synthetic oligonucleotide sequence
taagaggtcctatctgttcagtgtt

SEQ ID NO: 613 - DNA, 25 bp, Artificial sequence
  Synthetic oligonucleotide sequence
attcggcaaccctgatgagtttgtc

SEQ ID NO: 614 - DNA, 25 bp, Artificial sequence
  Synthetic oligonucleotide sequence
agggaccactggcagtacctatgtg

SEQ ID NO: 615 - DNA, 25 bp, Artificial sequence
  Synthetic oligonucleotide sequence
agcatggatgctagttcgccgtgga

SEQ ID NO: 616 - DNA, 25 bp, Artificial sequence
  Synthetic oligonucleotide sequence
aaaacccttggctttgattcagatt

SEQ ID NO: 617 - DNA, 25 bp, Artificial sequence
  Synthetic oligonucleotide sequence
gttgaaaggacaccgcagggaccac

SEQ ID NO: 618 - DNA, 25 bp, Artificial sequence
  Synthetic oligonucleotide sequence
gaggagcacgcgatacaagatttat

SEQ ID NO: 619 - DNA, 25 bp, Artificial sequence
  Synthetic oligonucleotide sequence
gattcagattgaggagcacgcgata

SEQ ID NO: 620 - DNA, 25 bp, Artificial sequence
  Synthetic oligonucleotide sequence
gttcgccgtggacttgagatgtatt

SEQ ID NO: 621 - DNA, 25 bp, Artificial sequence
  Synthetic oligonucleotide sequence
ggtgcattagctattatttctgatc

SEQ ID NO: 622 - DNA, 25 bp, Artificial sequence
  Synthetic oligonucleotide sequence
ggttttctatgaggcattcggcaac

SEQ ID NO: 623 - DNA, 25 bp, Artificial sequence
  Synthetic oligonucleotide sequence
ggatctaatttctttgctgcagttt

SEQ ID NO: 624 - DNA, 25 bp, Artificial sequence
  Synthetic oligonucleotide sequence
accagtgctgaacattagtgccttt

SEQ ID NO: 625 - DNA, 25 bp, Artificial sequence
  Synthetic oligonucleotide sequence
gaacctgctgaatttaacttaaccg

SEQ ID NO: 626 - DNA, 25 bp, Artificial sequence
  Synthetic oligonucleotide sequence
aaaatacagtcaacccttcaccatg

SEQ ID NO: 627 - DNA, 25 bp, Artificial sequence
  Synthetic oligonucleotide sequence
aagagttcagcttcacgtttgccaa

SEQ ID NO: 628 - DNA, 25 bp, Artificial sequence
  Synthetic oligonucleotide sequence
caacaggcggagacagctgtccttt

SEQ ID NO: 629 - DNA, 25 bp, Artificial sequence
  Synthetic oligonucleotide sequence
ccatatcacctgctatttccaagaa

SEQ ID NO: 630 - DNA, 25 bp, Artificial sequence
  Synthetic oligonucleotide sequence
gctgcatctcatacaatggctctct

SEQ ID NO: 631 - DNA, 25 bp, Artificial sequence
  Synthetic oligonucleotide sequence
gaaacagcccgatacataacactcc

SEQ ID NO: 632 - DNA, 25 bp, Artificial sequence
  Synthetic oligonucleotide sequence
tctgcccatcaattacactttcttt

SEQ ID NO: 633 - DNA, 25 bp, Artificial sequence
  Synthetic oligonucleotide sequence
taaccgagaggatcaccgtgacaaa

SEQ ID NO: 634 - DNA, 25 bp, Artificial sequence
  Synthetic oligonucleotide sequence
taatgctggcattttggatactacc

SEQ ID NO: 635 - DNA, 25 bp, Artificial sequence
  Synthetic oligonucleotide sequence
atggatccccttattattctttcac

SEQ ID NO: 636 - DNA, 25 bp, Artificial sequence
  Synthetic oligonucleotide sequence
agtttttacatctgcctcaaggcct

SEQ ID NO: 637 - DNA, 25 bp, Artificial sequence
  Synthetic oligonucleotide sequence
agaatgaaactgagtctccctggcc

SEQ ID NO: 638 - DNA, 25 bp, Artificial sequence
  Synthetic oligonucleotide sequence
agatccttcgcttgtctgcttaaaa

SEQ ID NO: 639 - DNA, 25 bp, Artificial sequence
  Synthetic oligonucleotide sequence
aattctgaacaactctctgcaactg

SEQ ID NO: 640 - DNA, 25 bp, Artificial sequence
  Synthetic oligonucleotide sequence
gttcctccttttctttaggtctcag

SEQ ID NO: 641 - DNA, 25 bp, Artificial sequence
  Synthetic oligonucleotide sequence
gcacgagctgacctggagtactaca

SEQ ID NO: 642 - DNA, 25 bp, Artificial sequence
  Synthetic oligonucleotide sequence
gacttcccagtgcactcagaatgaa

SEQ ID NO: 643 - DNA, 25 bp, Artificial sequence
  Synthetic oligonucleotide sequence
gagttctctatgtcacagtttttac

SEQ ID NO: 644 - DNA, 25 bp, Artificial sequence
  Synthetic oligonucleotide sequence
gtctcagcttacatatgtcaccttc

SEQ ID NO: 645 - DNA, 25 bp, Artificial sequence
  Synthetic oligonucleotide sequence
ttgtttatcactgtatccctagcac

SEQ ID NO: 646 - DNA, 25 bp, Artificial sequence
  Synthetic oligonucleotide sequence
atgctgcagctgtttgtcaggaaca

SEQ ID NO: 647 - DNA, 25 bp, Artificial sequence
  Synthetic oligonucleotide sequence
agtatttgccatcacatgctgcagc

SEQ ID NO: 648 - DNA, 25 bp, Artificial sequence
  Synthetic oligonucleotide sequence
acaattactggcttttctgctgtaa

SEQ ID NO: 649 - DNA, 25 bp, Artificial sequence
  Synthetic oligonucleotide sequence
cagtaatcacgctgcagaaattggc

SEQ ID NO: 650 - DNA, 25 bp, Artificial sequence
  Synthetic oligonucleotide sequence
gaacgcagcagcagggtacgtagca

SEQ ID NO: 651 - DNA, 25 bp, Artificial sequence
  Synthetic oligonucleotide sequence
gaaattggcagcctgcaccttatgc

SEQ ID NO: 652 - DNA, 25 bp, Artificial sequence
  Synthetic oligonucleotide sequence
tgtccgtttttatttgggcatccac

SEQ ID NO: 653 - DNA, 25 bp, Artificial sequence
  Synthetic oligonucleotide sequence
gggcatccaccacagacaatttaaa

SEQ ID NO: 654 - DNA, 25 bp, Artificial sequence
  Synthetic oligonucleotide sequence
ggtgtcattcattcattcagtaatc

SEQ ID NO: 655 - DNA, 25 bp, Artificial sequence
  Synthetic oligonucleotide sequence
taaatttcgtagatgcgctcagaac

SEQ ID NO: 656 - DNA, 25 bp, Artificial sequence
  Synthetic oligonucleotide sequence
ttatgcgtcaccattacctttagtc

SEQ ID NO: 657 - DNA, 25 bp, Artificial sequence
  Synthetic oligonucleotide sequence
atatgatttatcctgagtgctgtat

SEQ ID NO: 658 - DNA, 25 bp, Artificial sequence
  Synthetic oligonucleotide sequence
atcactcttttactttggttcctgt

SEQ ID NO: 659 - DNA, 25 bp, Artificial sequence
  Synthetic oligonucleotide sequence
agatacccagtatgcttaatgtgaa

SEQ ID NO: 660 - DNA, 25 bp, Artificial sequence
  Synthetic oligonucleotide sequence
acttggacagaggttgctgaacttt

SEQ ID NO: 661 - DNA, 25 bp, Artificial sequence
  Synthetic oligonucleotide sequence
aaaggtgttctagctgtttgcatca

SEQ ID NO: 662 - DNA, 25 bp, Artificial sequence
  Synthetic oligonucleotide sequence
aaaatagagttacatcagcctgatt

SEQ ID NO: 663 - DNA, 25 bp, Artificial sequence
  Synthetic oligonucleotide sequence
gttgacaattaatccattcctggca

SEQ ID NO: 664 - DNA, 25 bp, Artificial sequence
  Synthetic oligonucleotide sequence
gtgctgtatctatcactcttttact

SEQ ID NO: 665 - DNA, 25 bp, Artificial sequence
  Synthetic oligonucleotide sequence
tggttcctgttgtgctcttgtaaaa

SEQ ID NO: 666 - DNA, 25 bp, Artificial sequence
  Synthetic oligonucleotide sequence
taaatgcttgctttttgttttttca

SEQ ID NO: 667 - DNA, 25 bp, Artificial sequence
  Synthetic oligonucleotide sequence
ttgttttttcaatcatggccatatt

SEQ ID NO: 668 - DNA, 25 bp, Artificial sequence
  Synthetic oligonucleotide sequence
attgccatgaagttcctgctgggct

SEQ ID NO: 669 - DNA, 25 bp, Artificial sequence
  Synthetic oligonucleotide sequence
ctttcccttcctcaatgtacatagt

SEQ ID NO: 670 - DNA, 25 bp, Artificial sequence
  Synthetic oligonucleotide sequence
tgactttttgactgttgggctcact

SEQ ID NO: 671 - DNA, 25 bp, Artificial sequence
  Synthetic oligonucleotide sequence
gctgggcttcgtggaaacactgttt

SEQ ID NO: 672 - DNA, 25 bp, Artificial sequence
  Synthetic oligonucleotide sequence
gatgatacccagacttcaggagcca

SEQ ID NO: 673 - DNA, 25 bp, Artificial sequence
  Synthetic oligonucleotide sequence
gggcaggacatcagttttcatcagt

SEQ ID NO: 674 - DNA, 25 bp, Artificial sequence
  Synthetic oligonucleotide sequence
ggagtgttcctcctttatgtgaaaa

SEQ ID NO: 675 - DNA, 25 bp, Artificial sequence
  Synthetic oligonucleotide sequence
tgggctcacttccagttagtttgaa

SEQ ID NO: 676 - DNA, 25 bp, Artificial sequence
  Synthetic oligonucleotide sequence
ttccggttagacgtcattgccatga

SEQ ID NO: 677 - DNA, 25 bp, Artificial sequence
  Synthetic oligonucleotide sequence
tatccgtgtatgtcagtctgttttg

SEQ ID NO: 678 - DNA, 25 bp, Artificial sequence
  Synthetic oligonucleotide sequence
tttggactcctctgctagtgttaca

SEQ ID NO: 679 - DNA, 25 bp, Artificial sequence
  Synthetic oligonucleotide sequence
atctcttggagtttcagtactgtca

SEQ ID NO: 680 - DNA, 25 bp, Artificial sequence
  Synthetic oligonucleotide sequence
agaggtggtctgtaatggattcaaa

SEQ ID NO: 681 - DNA, 25 bp, Artificial sequence
  Synthetic oligonucleotide sequence
acatagttccactgtcatttctgaa

SEQ ID NO: 682 - DNA, 25 bp, Artificial sequence
  Synthetic oligonucleotide sequence
aaaaagctcgacagcactcaggtcc

SEQ ID NO: 683 - DNA, 25 bp, Artificial sequence
  Synthetic oligonucleotide sequence
aactaataggttactgcttcccaca

SEQ ID NO: 684 - DNA, 25 bp, Artificial sequence
  Synthetic oligonucleotide sequence
ccagtccatctcgtttctttataaa

SEQ ID NO: 685 - DNA, 25 bp, Artificial sequence
  Synthetic oligonucleotide sequence
gcttcccacactacattggttcaaa

SEQ ID NO: 686 - DNA, 25 bp, Artificial sequence
  Synthetic oligonucleotide sequence
gctctttaagtcatagcaccggtaa

SEQ ID NO: 687 - DNA, 25 bp, Artificial sequence
  Synthetic oligonucleotide sequence
gagttccggtatctaagtcacaatt

SEQ ID NO: 688 - DNA, 25 bp, Artificial sequence
  Synthetic oligonucleotide sequence
ggttgcagcaaactttttaactgat

SEQ ID NO: 689 - DNA, 25 bp, Artificial sequence
  Synthetic oligonucleotide sequence
taaaggcattgttccttccagtcca

SEQ ID NO: 690 - DNA, 25 bp, Artificial sequence
  Synthetic oligonucleotide sequence
ataattgcctgaattcgttcccttg

SEQ ID NO: 691 - DNA, 25 bp, Artificial sequence
  Synthetic oligonucleotide sequence
agggaagcacttcctccgagggcat

SEQ ID NO: 692 - DNA, 25 bp, Artificial sequence
  Synthetic oligonucleotide sequence
cttctgaaccttgtcattttcgtga

SEQ ID NO: 693 - DNA, 25 bp, Artificial sequence
  Synthetic oligonucleotide sequence
agcagtgtcgagagccatcgcgtgt

SEQ ID NO: 694 - DNA, 25 bp, Artificial sequence
  Synthetic oligonucleotide sequence
gcaagctgcctgtaaatcgactcta

SEQ ID NO: 695 - DNA, 25 bp, Artificial sequence
  Synthetic oligonucleotide sequence
gaatgatgactgtctgtctctcttt

SEQ ID NO: 696 - DNA, 25 bp, Artificial sequence
  Synthetic oligonucleotide sequence
gaaatgcagtcttttaacctatgaa

SEQ ID NO: 697 - DNA, 25 bp, Artificial sequence
  Synthetic oligonucleotide sequence
gtaacggcagatttctccattgaga

SEQ ID NO: 698 - DNA, 25 bp, Artificial sequence
  Synthetic oligonucleotide sequence
gtctctcttttttccgtgacaaatc

SEQ ID NO: 699 - DNA, 25 bp, Artificial sequence
  Synthetic oligonucleotide sequence
ggaagaggtttcattcacacccgaa

SEQ ID NO: 700 - DNA, 25 bp, Artificial sequence
  Synthetic oligonucleotide sequence
tacacccttggtgccttggagcaaa

SEQ ID NO: 701 - DNA, 25 bp, Artificial sequence
  Synthetic oligonucleotide sequence
aaaccttttggtgtacatcctctgg

SEQ ID NO: 702 - DNA, 25 bp, Artificial sequence
  Synthetic oligonucleotide sequence
agatatctgtctcattcattccact

SEQ ID NO: 703 - DNA, 25 bp, Artificial sequence
  Synthetic oligonucleotide sequence
acttgcactgtctcctgggatcttg

SEQ ID NO: 704 - DNA, 25 bp, Artificial sequence
  Synthetic oligonucleotide sequence
aacaagtggcttcctttttgagata

SEQ ID NO: 705 - DNA, 25 bp, Artificial sequence
  Synthetic oligonucleotide sequence
ctttctttccacagcacttttgata

SEQ ID NO: 706 - DNA, 25 bp, Artificial sequence
  Synthetic oligonucleotide sequence
ctccctgtggcacttgacattttaa

SEQ ID NO: 707 - DNA, 25 bp, Artificial sequence
  Synthetic oligonucleotide sequence
gtaaggcaatctttcctgttgtaaa

SEQ ID NO: 708 - DNA, 25 bp, Artificial sequence
  Synthetic oligonucleotide sequence
gtgtgatcccatcatgagttcattg

SEQ ID NO: 709 - DNA, 25 bp, Artificial sequence
  Synthetic oligonucleotide sequence
tgggatcttgtctgcagcccgacgt

SEQ ID NO: 710 - DNA, 25 bp, Artificial sequence
  Synthetic oligonucleotide sequence
ggccccttaagtgctgccagaagca

SEQ ID NO: 711 - DNA, 25 bp, Artificial sequence
  Synthetic oligonucleotide sequence
ttctggttatcatttatcctccctg

SEQ ID NO: 712 - DNA, 25 bp, Artificial sequence
  Synthetic oligonucleotide sequence
attgtggatttgtcagtttctctct

SEQ ID NO: 713 - DNA, 25 bp, Artificial sequence
  Synthetic oligonucleotide sequence
attcttcataagagctgttgccaaa

SEQ ID NO: 714 - DNA, 25 bp, Artificial sequence
  Synthetic oligonucleotide sequence
attcatttcactgtactcttgccag

SEQ ID NO: 715 - DNA, 25 bp, Artificial sequence
  Synthetic oligonucleotide sequence
atcactccagtgatggttgtggtgg

SEQ ID NO: 716 - DNA, 25 bp, Artificial sequence
  Synthetic oligonucleotide sequence
aaagcatagttcagtgccactcaca

SEQ ID NO: 717 - DNA, 25 bp, Artificial sequence
  Synthetic oligonucleotide sequence
aagtatgttgaagtgtctctctgtc

SEQ ID NO: 718 - DNA, 25 bp, Artificial sequence
  Synthetic oligonucleotide sequence
aagtgtctctctgtcattgtggatt

SEQ ID NO: 719 - DNA, 25 bp, Artificial sequence
  Synthetic oligonucleotide sequence
aattgcccttgtctcataatgcttt

SEQ ID NO: 720 - DNA, 25 bp, Artificial sequence
  Synthetic oligonucleotide sequence
caggtgcctaatgtgcggtctttaa

SEQ ID NO: 721 - DNA, 25 bp, Artificial sequence
  Synthetic oligonucleotide sequence
tgtctacttggttttaccaccttct

SEQ ID NO: 722 - DNA, 25 bp, Artificial sequence
  Synthetic oligonucleotide sequence
tcagtttctctctgcatttctcaga

SEQ ID NO: 723 - DNA, 25 bp, Artificial sequence
  Synthetic oligonucleotide sequence
atcagttcatccacctcattattaa

SEQ ID NO: 724 - DNA, 25 bp, Artificial sequence
  Synthetic oligonucleotide sequence
aggttgattcttagccagtggtggt

SEQ ID NO: 725 - DNA, 25 bp, Artificial sequence
  Synthetic oligonucleotide sequence
agtgtttctggacatttctctttga

SEQ ID NO: 726 - DNA, 25 bp, Artificial sequence
  Synthetic oligonucleotide sequence
caggttctttagtactcagtgtttc

SEQ ID NO: 727 - DNA, 25 bp, Artificial sequence
  Synthetic oligonucleotide sequence
gtgacctaacgagaagacccgcata

SEQ ID NO: 728 - DNA, 25 bp, Artificial sequence
  Synthetic oligonucleotide sequence
gatgcctcattggtggaattcctct

SEQ ID NO: 729 - DNA, 25 bp, Artificial sequence
  Synthetic oligonucleotide sequence
gtattgtaaccgctgaattcactcc

SEQ ID NO: 730 - DNA, 25 bp, Artificial sequence
  Synthetic oligonucleotide sequence
gtgcctatatccgagagacctatgt

SEQ ID NO: 731 - DNA, 25 bp, Artificial sequence
  Synthetic oligonucleotide sequence
gtgagacttcaaacatggtgcctat

SEQ ID NO: 732 - DNA, 25 bp, Artificial sequence
  Synthetic oligonucleotide sequence
tcaaacccatgcacagtccaataat

SEQ ID NO: 733 - DNA, 25 bp, Artificial sequence
  Synthetic oligonucleotide sequence
tactttgccccttctttcaagatta

SEQ ID NO: 734 - DNA, 25 bp, Artificial sequence
  Synthetic oligonucleotide sequence
aggactttcagttgggttgcagcta

SEQ ID NO: 735 - DNA, 25 bp, Artificial sequence
  Synthetic oligonucleotide sequence
ccataacttttaactgcaagccagt

SEQ ID NO: 736 - DNA, 25 bp, Artificial sequence
  Synthetic oligonucleotide sequence
aacatcctcttgacgtgcagagcat

SEQ ID NO: 737 - DNA, 25 bp, Artificial sequence
  Synthetic oligonucleotide sequence
aattgctggagcataactgcttcaa

SEQ ID NO: 738 - DNA, 25 bp, Artificial sequence
  Synthetic oligonucleotide sequence
cagggttttaacatgcttgacttta

SEQ ID NO: 739 - DNA, 25 bp, Artificial sequence
  Synthetic oligonucleotide sequence
gtacaccatatcactctgatacctt

SEQ ID NO: 740 - DNA, 25 bp, Artificial sequence
  Synthetic oligonucleotide sequence
gtgccagacagctaaatctttatca

SEQ ID NO: 741 - DNA, 25 bp, Artificial sequence
  Synthetic oligonucleotide sequence
gggttgcagctattacacgcatgat

SEQ ID NO: 742 - DNA, 25 bp, Artificial sequence
  Synthetic oligonucleotide sequence
ggagttatttcaggccaatcatttt

SEQ ID NO: 743 - DNA, 25 bp, Artificial sequence
  Synthetic oligonucleotide sequence
tgtctgccagcaccaaggactttca

SEQ ID NO: 744 - DNA, 25 bp, Artificial sequence
  Synthetic oligonucleotide sequence
ggccaatcatttttaacatcctctt

SEQ ID NO: 745 - DNA, 25 bp, Artificial sequence
  Synthetic oligonucleotide sequence
atctttgacatcttagccatcctaa

SEQ ID NO: 746 - DNA, 25 bp, Artificial sequence
  Synthetic oligonucleotide sequence
agaaggctcctgattcagatcctcc

SEQ ID NO: 747 - DNA, 25 bp, Artificial sequence
  Synthetic oligonucleotide sequence
acatcgtctcccaagtcttttgaat

SEQ ID NO: 748 - DNA, 25 bp, Artificial sequence
  Synthetic oligonucleotide sequence
acaggactgctaatccctttgagtt

SEQ ID NO: 749 - DNA, 25 bp, Artificial sequence
  Synthetic oligonucleotide sequence
aaacatcctggtcattctttagcgt

SEQ ID NO: 750 - DNA, 25 bp, Artificial sequence
  Synthetic oligonucleotide sequence
aagtcagctaaggagtccgtgccag

SEQ ID NO: 751 - DNA, 25 bp, Artificial sequence
  Synthetic oligonucleotide sequence
gctgcaacataccaggcattgtgct

SEQ ID NO: 752 - DNA, 25 bp, Artificial sequence
  Synthetic oligonucleotide sequence
gaatggaaaccatctcatctttgac

SEQ ID NO: 753 - DNA, 25 bp, Artificial sequence
  Synthetic oligonucleotide sequence
gactgggccccagtgagttcagaaa

SEQ ID NO: 754 - DNA, 25 bp, Artificial sequence
  Synthetic oligonucleotide sequence
ggcaggtgattctgtcgtgcacaag

SEQ ID NO: 755 - DNA, 25 bp, Artificial sequence
  Synthetic oligonucleotide sequence
tctctgttcaattttcccttttcta

SEQ ID NO: 756 - DNA, 25 bp, Artificial sequence
  Synthetic oligonucleotide sequence
ataagttctatttccacctgatgct

SEQ ID NO: 757 - DNA, 25 bp, Artificial sequence
  Synthetic oligonucleotide sequence
agagacttcattcctggtgtggcca

SEQ ID NO: 758 - DNA, 25 bp, Artificial sequence
  Synthetic oligonucleotide sequence
aaagttattgtcgtggtgtcccagc

SEQ ID NO: 759 - DNA, 25 bp, Artificial sequence
  Synthetic oligonucleotide sequence
cagcacttcattcagagccgatggt

SEQ ID NO: 760 - DNA, 25 bp, Artificial sequence
  Synthetic oligonucleotide sequence
gcgggtcggttttcagtatactcat

SEQ ID NO: 761 - DNA, 25 bp, Artificial sequence
  Synthetic oligonucleotide sequence
ctgatgcttcttgctggctgcaaaa

SEQ ID NO: 762 - DNA, 25 bp, Artificial sequence
  Synthetic oligonucleotide sequence
gcatgcccgtgctgggttttaacaa

SEQ ID NO: 763 - DNA, 25 bp, Artificial sequence
  Synthetic oligonucleotide sequence
gatgcctttgttatctactcaagcc

SEQ ID NO: 764 - DNA, 25 bp, Artificial sequence
  Synthetic oligonucleotide sequence
ggtgtgtgcaatacccttacagatg

SEQ ID NO: 765 - DNA, 25 bp, Artificial sequence
  Synthetic oligonucleotide sequence
tgagtatgagattgcccagacctgg

SEQ ID NO: 766 - DNA, 25 bp, Artificial sequence
  Synthetic oligonucleotide sequence
ttaacaatgccacctgtcagattag

SEQ ID NO: 767 - DNA, 25 bp, Artificial sequence
  Synthetic oligonucleotide sequence
atatagaagctccatgggctgccca

SEQ ID NO: 768 - DNA, 25 bp, Artificial sequence
  Synthetic oligonucleotide sequence
gagggaaacgactccttgtctttca

SEQ ID NO: 769 - DNA, 25 bp, Artificial sequence
  Synthetic oligonucleotide sequence
aggagacctggttgccttatacctt

SEQ ID NO: 770 - DNA, 25 bp, Artificial sequence
  Synthetic oligonucleotide sequence
agattcatgcgatccagtctgtata

SEQ ID NO: 771 - DNA, 25 bp, Artificial sequence
  Synthetic oligonucleotide sequence
ctgtgatgaccgagaagcctttctt

SEQ ID NO: 772 - DNA, 25 bp, Artificial sequence
  Synthetic oligonucleotide sequence
gaacacggaataaactcccactgca

SEQ ID NO: 773 - DNA, 25 bp, Artificial sequence
  Synthetic oligonucleotide sequence
ggctgcccatctgtagatagctgta

SEQ ID NO: 774 - DNA, 25 bp, Artificial sequence
  Synthetic oligonucleotide sequence
ggctcctttggatattctgtgatga

SEQ ID NO: 775 - DNA, 25 bp, Artificial sequence
  Synthetic oligonucleotide sequence
tgcacatcctgtctacaccataagt

SEQ ID NO: 776 - DNA, 25 bp, Artificial sequence
  Synthetic oligonucleotide sequence
ttgccttatacctttacgcgaacac

SEQ ID NO: 777 - DNA, 25 bp, Artificial sequence
  Synthetic oligonucleotide sequence
ttgtctttcatgctgtgaggctcct

SEQ ID NO: 778 - DNA, 25 bp, Artificial sequence
  Synthetic oligonucleotide sequence
atcagtgcctgcctgcgttaggaga

SEQ ID NO: 779 - DNA, 25 bp, Artificial sequence
  Synthetic oligonucleotide sequence
agaactggattttcttcctcaaaat

SEQ ID NO: 780 - DNA, 25 bp, Artificial sequence
  Synthetic oligonucleotide sequence
aaacttttccctttgacatgctctg

SEQ ID NO: 781 - DNA, 25 bp, Artificial sequence
  Synthetic oligonucleotide sequence
cagcatgtcctgtaagctcagatag

SEQ ID NO: 782 - DNA, 25 bp, Artificial sequence
  Synthetic oligonucleotide sequence
catgctctgatttttgttgtttggg

SEQ ID NO: 783 - DNA, 25 bp, Artificial sequence
  Synthetic oligonucleotide sequence
gactccaagggttttgatcagtatc

SEQ ID NO: 784 - DNA, 25 bp, Artificial sequence
  Synthetic oligonucleotide sequence
gatagactctgttgactccaagggt

SEQ ID NO: 785 - DNA, 25 bp, Artificial sequence
  Synthetic oligonucleotide sequence
gtgtgcagcctgatttaaaaccaac

SEQ ID NO: 786 - DNA, 25 bp, Artificial sequence
  Synthetic oligonucleotide sequence
gtgtgtgcggtgtccaccagtatca

SEQ ID NO: 787 - DNA, 25 bp, Artificial sequence
  Synthetic oligonucleotide sequence
ggagaattacattcctggttctgta

SEQ ID NO: 788 - DNA, 25 bp, Artificial sequence
  Synthetic oligonucleotide sequence
ttgctagctgaagccagtttgacat

SEQ ID NO: 789 - DNA, 25 bp, Artificial sequence
  Synthetic oligonucleotide sequence
attaagagggatcagctggctaagt

SEQ ID NO: 790 - DNA, 25 bp, Artificial sequence
  Synthetic oligonucleotide sequence
atatctttgagtgtgttcctggcag

SEQ ID NO: 791 - DNA, 25 bp, Artificial sequence
  Synthetic oligonucleotide sequence
atcttctttgatgcttttgtacttt

SEQ ID NO: 792 - DNA, 25 bp, Artificial sequence
  Synthetic oligonucleotide sequence
ttgttaaagccccagtagccacctt

SEQ ID NO: 793 - DNA, 25 bp, Artificial sequence
  Synthetic oligonucleotide sequence
aaattatgacctcttcctttaggag

SEQ ID NO: 794 - DNA, 25 bp, Artificial sequence
  Synthetic oligonucleotide sequence
aaacctctcagatactgctactgta

SEQ ID NO: 795 - DNA, 25 bp, Artificial sequence
  Synthetic oligonucleotide sequence
gctattgttccagcagttttaacgt

SEQ ID NO: 796 - DNA, 25 bp, Artificial sequence
  Synthetic oligonucleotide sequence
gaaattctccagtttttgattatta

SEQ ID NO: 797 - DNA, 25 bp, Artificial sequence
  Synthetic oligonucleotide sequence
gtagccaccttttgggcatatttga

SEQ ID NO: 798 - DNA, 25 bp, Artificial sequence
  Synthetic oligonucleotide sequence
tactaggtaacttcacattgctctg

SEQ ID NO: 799 - DNA, 25 bp, Artificial sequence
  Synthetic oligonucleotide sequence
tatacacctttattaatcgctattg

SEQ ID NO: 800 - DNA, 25 bp, Artificial sequence
  Synthetic oligonucleotide sequence
acgaagtggtgtgccggtactgatc

SEQ ID NO: 801 - DNA, 25 bp, Artificial sequence
  Synthetic oligonucleotide sequence
caacggtcatttgttttcaaggtca

SEQ ID NO: 802 - DNA, 25 bp, Artificial sequence
  Synthetic oligonucleotide sequence
actagtgttgtagcctgttggtact

SEQ ID NO: 803 - DNA, 25 bp, Artificial sequence
  Synthetic oligonucleotide sequence
aaggaactctctcttggtttggtca

SEQ ID NO: 804 - DNA, 25 bp, Artificial sequence
  Synthetic oligonucleotide sequence
gttagtcatcgatttggtctcctgt

SEQ ID NO: 805 - DNA, 25 bp, Artificial sequence
  Synthetic oligonucleotide sequence
gtacttatagtaccagtgtcctgga

SEQ ID NO: 806 - DNA, 25 bp, Artificial sequence
  Synthetic oligonucleotide sequence
ggtcatattatttcacaacggtcat

SEQ ID NO: 807 - DNA, 25 bp, Artificial sequence
  Synthetic oligonucleotide sequence
tgttattgttatctgctgtgctggc

SEQ ID NO: 808 - DNA, 25 bp, Artificial sequence
  Synthetic oligonucleotide sequence
tctcctgttgcattcctggatgtat

SEQ ID NO: 809 - DNA, 25 bp, Artificial sequence
  Synthetic oligonucleotide sequence
tccccttcgttactgtggtatgtta

SEQ ID NO: 810 - DNA, 25 bp, Artificial sequence
  Synthetic oligonucleotide sequence
tagacgctccgcttacgaagtggtg

SEQ ID NO: 811 - DNA, 25 bp, Artificial sequence
  Synthetic oligonucleotide sequence
attctttgtgtgctgtgtgtattat

SEQ ID NO: 812 - DNA, 25 bp, Artificial sequence
  Synthetic oligonucleotide sequence
aactataccttgtataccgcactcc

SEQ ID NO: 813 - DNA, 25 bp, Artificial sequence
  Synthetic oligonucleotide sequence
aagtgtgtttgcctacatgctgtat

SEQ ID NO: 814 - DNA, 25 bp, Artificial sequence
  Synthetic oligonucleotide sequence
cttcttgtagtctcttcttccaaag

SEQ ID NO: 815 - DNA, 25 bp, Artificial sequence
  Synthetic oligonucleotide sequence
ctgccccattttgacttctgagatg

SEQ ID NO: 816 - DNA, 25 bp, Artificial sequence
  Synthetic oligonucleotide sequence
gcctttttctatacatgcacttaac

SEQ ID NO: 817 - DNA, 25 bp, Artificial sequence
  Synthetic oligonucleotide sequence
gatccattattattttcctattgcc

SEQ ID NO: 818 - DNA, 25 bp, Artificial sequence
  Synthetic oligonucleotide sequence
gtgatctgcagcttcagtggtgtaa

SEQ ID NO: 819 - DNA, 25 bp, Artificial sequence
  Synthetic oligonucleotide sequence
gtgtacatctgcttgtgtgatctgc

SEQ ID NO: 820 - DNA, 25 bp, Artificial sequence
  Synthetic oligonucleotide sequence
gtgctaatgtgatctttctcctgac

SEQ ID NO: 821 - DNA, 25 bp, Artificial sequence
  Synthetic oligonucleotide sequence
tactggcgtgtttaccttcttgtag

SEQ ID NO: 822 - DNA, 25 bp, Artificial sequence
  Synthetic oligonucleotide sequence
tcaccagtcagttgctcacaaagtc

SEQ ID NO: 823 - DNA, 25 bp, Artificial sequence
  Synthetic oligonucleotide sequence
atgcagatcataccaccccaaagta

SEQ ID NO: 824 - DNA, 25 bp, Artificial sequence
  Synthetic oligonucleotide sequence
agtattttaattgcaccttagtgaa

SEQ ID NO: 825 - DNA, 25 bp, Artificial sequence
  Synthetic oligonucleotide sequence
aaggtaacttgtccaaagccagaat

SEQ ID NO: 826 - DNA, 25 bp, Artificial sequence
  Synthetic oligonucleotide sequence
aaaactagtatgctggcttgaaata

SEQ ID NO: 827 - DNA, 25 bp, Artificial sequence
  Synthetic oligonucleotide sequence
aagaatctagacttcaccagtcagt

SEQ ID NO: 828 - DNA, 25 bp, Artificial sequence
  Synthetic oligonucleotide sequence
ctttacactgttacctgcttaggaa

SEQ ID NO: 829 - DNA, 25 bp, Artificial sequence
  Synthetic oligonucleotide sequence
gagggagataatagccctcccacca

SEQ ID NO: 830 - DNA, 25 bp, Artificial sequence
  Synthetic oligonucleotide sequence
gtttgaacagttgtgtccagattga

SEQ ID NO: 831 - DNA, 25 bp, Artificial sequence
  Synthetic oligonucleotide sequence
taccaccccaaagtagctctttaat

SEQ ID NO: 832 - DNA, 25 bp, Artificial sequence
  Synthetic oligonucleotide sequence
tactggaatcctttacactgttacc

SEQ ID NO: 833 - DNA, 25 bp, Artificial sequence
  Synthetic oligonucleotide sequence
aaatcacttttctttcccactgact

SEQ ID NO: 834 - DNA, 25 bp, Artificial sequence
  Synthetic oligonucleotide sequence
cactgactgttttttctgcttgttg

SEQ ID NO: 835 - DNA, 25 bp, Artificial sequence
  Synthetic oligonucleotide sequence
cttgtgggtattgctgtcttgtttt

SEQ ID NO: 836 - DNA, 25 bp, Artificial sequence
  Synthetic oligonucleotide sequence
ctgcccattggcctgaaaatactca

SEQ ID NO: 837 - DNA, 25 bp, Artificial sequence
  Synthetic oligonucleotide sequence
ctccttatcgcttacagtgttctta

SEQ ID NO: 838 - DNA, 25 bp, Artificial sequence
  Synthetic oligonucleotide sequence
gaatgaaatttcctacgcactactg

SEQ ID NO: 839 - DNA, 25 bp, Artificial sequence
  Synthetic oligonucleotide sequence
gagaacctcgtgtctgttctgattc

SEQ ID NO: 840 - DNA, 25 bp, Artificial sequence
  Synthetic oligonucleotide sequence
gatatgttcttgtattgactgccca

SEQ ID NO: 841 - DNA, 25 bp, Artificial sequence
  Synthetic oligonucleotide sequence
tccttccctgatgctaaatttccaa

SEQ ID NO: 842 - DNA, 25 bp, Artificial sequence
  Synthetic oligonucleotide sequence
taaggtcccttctaactttcatgtc

SEQ ID NO: 843 - DNA, 25 bp, Artificial sequence
  Synthetic oligonucleotide sequence
ttaggcaatctttcttctccttatc

SEQ ID NO: 844 - DNA, 25 bp, Artificial sequence
  Synthetic oligonucleotide sequence
attagctctgtggtgtcaggctcta

SEQ ID NO: 845 - DNA, 25 bp, Artificial sequence
  Synthetic oligonucleotide sequence
agtgcatctgtgtatcctggtttaa

SEQ ID NO: 846 - DNA, 25 bp, Artificial sequence
  Synthetic oligonucleotide sequence
agccatttaagggtggacctccacg

SEQ ID NO: 847 - DNA, 25 bp, Artificial sequence
  Synthetic oligonucleotide sequence
agccttttcagcctccattttgaag

SEQ ID NO: 848 - DNA, 25 bp, Artificial sequence
  Synthetic oligonucleotide sequence
aagaggacctctgacttgcttgaga

SEQ ID NO: 849 - DNA, 25 bp, Artificial sequence
  Synthetic oligonucleotide sequence
caggctctagagttacttcttgtca

SEQ ID NO: 850 - DNA, 25 bp, Artificial sequence
  Synthetic oligonucleotide sequence
gcatagtttgcagccgtgtggtagt

SEQ ID NO: 851 - DNA, 25 bp, Artificial sequence
  Synthetic oligonucleotide sequence
gaaaattagctctctgccatggttt

SEQ ID NO: 852 - DNA, 25 bp, Artificial sequence
  Synthetic oligonucleotide sequence
gagttctgtcagacttttccttttt

SEQ ID NO: 853 - DNA, 25 bp, Artificial sequence
  Synthetic oligonucleotide sequence
gattgttccttgcatttctgagtat

SEQ ID NO: 854 - DNA, 25 bp, Artificial sequence
  Synthetic oligonucleotide sequence
ggacctccacgacgattctgaaaat

SEQ ID NO: 855 - DNA, 25 bp, Artificial sequence
  Synthetic oligonucleotide sequence
agtccaggaccatacagcttcacag

SEQ ID NO: 856 - DNA, 25 bp, Artificial sequence
  Synthetic oligonucleotide sequence
caacctaccaacactgaatcatcat

SEQ ID NO: 857 - DNA, 25 bp, Artificial sequence
  Synthetic oligonucleotide sequence
gaaacccatccagattttaccagtg

SEQ ID NO: 858 - DNA, 25 bp, Artificial sequence
  Synthetic oligonucleotide sequence
gttctacaggattttggcttactca

SEQ ID NO: 859 - DNA, 25 bp, Artificial sequence
  Synthetic oligonucleotide sequence
gtggcatacaattcccaaattcatt

SEQ ID NO: 860 - DNA, 25 bp, Artificial sequence
  Synthetic oligonucleotide sequence
ggtatacatatgcttctacgcctgg

SEQ ID NO: 861 - DNA, 25 bp, Artificial sequence
  Synthetic oligonucleotide sequence
ggcagatgtgtattattatggcttc

SEQ ID NO: 862 - DNA, 25 bp, Artificial sequence
  Synthetic oligonucleotide sequence
ggcttcatcattctttttcttttgg

SEQ ID NO: 863 - DNA, 25 bp, Artificial sequence
  Synthetic oligonucleotide sequence
ggcttactcagtttgctcttagtga

SEQ ID NO: 864 - DNA, 25 bp, Artificial sequence
  Synthetic oligonucleotide sequence
tgtcttgctttatattttctctgaa

SEQ ID NO: 865 - DNA, 25 bp, Artificial sequence
  Synthetic oligonucleotide sequence
ttctacgcctggtatggaggtcaca

SEQ ID NO: 866 - DNA, 25 bp, Artificial sequence
  Synthetic oligonucleotide sequence
tttcgactggcgcaacgtttggtaa

SEQ ID NO: 867 - DNA, 25 bp, Artificial sequence
  Synthetic oligonucleotide sequence
ataacttttgtaccgtgccctctat

SEQ ID NO: 868 - DNA, 25 bp, Artificial sequence
  Synthetic oligonucleotide sequence
agtggttaaggcttcctatccagaa

SEQ ID NO: 869 - DNA, 25 bp, Artificial sequence
  Synthetic oligonucleotide sequence
agcccagcttcctgagtaccaataa

SEQ ID NO: 870 - DNA, 25 bp, Artificial sequence
  Synthetic oligonucleotide sequence
cagtgactgacccatatgtagcaaa

SEQ ID NO: 871 - DNA, 25 bp, Artificial sequence
  Synthetic oligonucleotide sequence
gcctgcagcgtgagaagacttccca

SEQ ID NO: 872 - DNA, 25 bp, Artificial sequence
  Synthetic oligonucleotide sequence
gctgctcactcactgtgggatgtta

SEQ ID NO: 873 - DNA, 25 bp, Artificial sequence
  Synthetic oligonucleotide sequence
gataatacccactttctaggattgt

SEQ ID NO: 874 - DNA, 25 bp, Artificial sequence
  Synthetic oligonucleotide sequence
gatgttatgaaagcgacccttccaa

SEQ ID NO: 875 - DNA, 25 bp, Artificial sequence
  Synthetic oligonucleotide sequence
taacgtttgaccctgaggcccagag

SEQ ID NO: 876 - DNA, 25 bp, Artificial sequence
  Synthetic oligonucleotide sequence
ttccttctggatcgtttctccaaga

SEQ ID NO: 877 - DNA, 25 bp, Artificial sequence
  Synthetic oligonucleotide sequence
atgtatgagacagcttcctccattg

SEQ ID NO: 878 - DNA, 25 bp, Artificial sequence
  Synthetic oligonucleotide sequence
agtgccctttcagtataccgtgttg

SEQ ID NO: 879 - DNA, 25 bp, Artificial sequence
  Synthetic oligonucleotide sequence
aaatgctttctctgtgctttcgtta

SEQ ID NO: 880 - DNA, 25 bp, Artificial sequence
  Synthetic oligonucleotide sequence
aaacaaatctcttctaccagcttgc

SEQ ID NO: 881 - DNA, 25 bp, Artificial sequence
  Synthetic oligonucleotide sequence
aatccaggtcttctgattctcattc

SEQ ID NO: 882 - DNA, 25 bp, Artificial sequence
  Synthetic oligonucleotide sequence
aatcagtcgaggtcagcagtttgta

SEQ ID NO: 883 - DNA, 25 bp, Artificial sequence
  Synthetic oligonucleotide sequence
gcttgcactcagaccaacttggaaa

SEQ ID NO: 884 - DNA, 25 bp, Artificial sequence
  Synthetic oligonucleotide sequence
gaattgttgttcttcctctttccta

SEQ ID NO: 885 - DNA, 25 bp, Artificial sequence
  Synthetic oligonucleotide sequence
gagccctctgtctgtgttttcatca

SEQ ID NO: 886 - DNA, 25 bp, Artificial sequence
  Synthetic oligonucleotide sequence
gattgcagctccttatttactggaa

SEQ ID NO: 887 - DNA, 25 bp, Artificial sequence
  Synthetic oligonucleotide sequence
gtataccgtgttgcctctaaagatt

SEQ ID NO: 888 - DNA, 25 bp, Artificial sequence
  Synthetic oligonucleotide sequence
attgtcatctctgaggtgtccacag

SEQ ID NO: 889 - DNA, 25 bp, Artificial sequence
  Synthetic oligonucleotide sequence
aggtccccagaggttttgtgtgcaa

SEQ ID NO: 890 - DNA, 25 bp, Artificial sequence
  Synthetic oligonucleotide sequence
aaatcattgtttttctcacctcgct

SEQ ID NO: 891 - DNA, 25 bp, Artificial sequence
  Synthetic oligonucleotide sequence
gaaaccctggctctgtaatcatgtg

SEQ ID NO: 892 - DNA, 25 bp, Artificial sequence
  Synthetic oligonucleotide sequence
gatcaagactggtgcaccttgccga

SEQ ID NO: 893 - DNA, 25 bp, Artificial sequence
  Synthetic oligonucleotide sequence
gtctggagccgtgtgttgtatctac

SEQ ID NO: 894 - DNA, 25 bp, Artificial sequence
  Synthetic oligonucleotide sequence
ggtagttgttaactggcctctccta

SEQ ID NO: 895 - DNA, 25 bp, Artificial sequence
  Synthetic oligonucleotide sequence
ggccaagtacaaccagatcctcaga

SEQ ID NO: 896 - DNA, 25 bp, Artificial sequence
  Synthetic oligonucleotide sequence
tgcagtcactggtcagctcattaga

SEQ ID NO: 897 - DNA, 25 bp, Artificial sequence
  Synthetic oligonucleotide sequence
tttgccggcaggaacttcagaaacc

SEQ ID NO: 898 - DNA, 25 bp, Artificial sequence
  Synthetic oligonucleotide sequence
tactgttctcactgcttccttagaa

SEQ ID NO: 899 - DNA, 25 bp, Artificial sequence
  Synthetic oligonucleotide sequence
aaagctatgtgcaagtcccaacctc

SEQ ID NO: 900 - DNA, 25 bp, Artificial sequence
  Synthetic oligonucleotide sequence
aaatctggtgctattttccactctt

SEQ ID NO: 901 - DNA, 25 bp, Artificial sequence
  Synthetic oligonucleotide sequence
aaacacgttttaaggctatctgcta

SEQ ID NO: 902 - DNA, 25 bp, Artificial sequence
  Synthetic oligonucleotide sequence
aagaacatggctcttctgacgcctt

SEQ ID NO: 903 - DNA, 25 bp, Artificial sequence
  Synthetic oligonucleotide sequence
aaggaaggatcctccctagagcctt

SEQ ID NO: 904 - DNA, 25 bp, Artificial sequence
  Synthetic oligonucleotide sequence
ccaacctcgggtacctatgaatgta

SEQ ID NO: 905 - DNA, 25 bp, Artificial sequence
  Synthetic oligonucleotide sequence
gctcctatattccaaagtctcttta

SEQ ID NO: 906 - DNA, 25 bp, Artificial sequence
  Synthetic oligonucleotide sequence
gatagtactccttgcgtttattgaa

SEQ ID NO: 907 - DNA, 25 bp, Artificial sequence
  Synthetic oligonucleotide sequence
gtgagttgaattgtgttccccaaaa

SEQ ID NO: 908 - DNA, 25 bp, Artificial sequence
  Synthetic oligonucleotide sequence
tgacgccttgattttgcactcacag

SEQ ID NO: 909 - DNA, 25 bp, Artificial sequence
  Synthetic oligonucleotide sequence
ttcgtcacctctctattcattattt

SEQ ID NO: 910 - DNA, 25 bp, Artificial sequence
  Synthetic oligonucleotide sequence
atctgtcagcgtgtttctttactac

SEQ ID NO: 911 - DNA, 25 bp, Artificial sequence
  Synthetic oligonucleotide sequence
agtggctgcatctccaggacagact

SEQ ID NO: 912 - DNA, 25 bp, Artificial sequence
  Synthetic oligonucleotide sequence
gaagacattacccagactacctaaa

SEQ ID NO: 913 - DNA, 25 bp, Artificial sequence
  Synthetic oligonucleotide sequence
aagctgagattagacctcccatcgg

SEQ ID NO: 914 - DNA, 25 bp, Artificial sequence
  Synthetic oligonucleotide sequence
gtagcgcagacagcagtgcctgtat

SEQ ID NO: 915 - DNA, 25 bp, Artificial sequence
  Synthetic oligonucleotide sequence
gtagatggcccattcccagaagaaa

SEQ ID NO: 916 - DNA, 25 bp, Artificial sequence
  Synthetic oligonucleotide sequence
ggaattttgttcagtcagcctttac

SEQ ID NO: 917 - DNA, 25 bp, Artificial sequence
  Synthetic oligonucleotide sequence
ggagcacccagttgctggtttctaa

SEQ ID NO: 918 - DNA, 25 bp, Artificial sequence
  Synthetic oligonucleotide sequence
tgctgagttctagccactgatctta

SEQ ID NO: 919 - DNA, 25 bp, Artificial sequence
  Synthetic oligonucleotide sequence
tagagagcatttccaatcaacccac

SEQ ID NO: 920 - DNA, 25 bp, Artificial sequence
  Synthetic oligonucleotide sequence
tttatttctgcctctggataccaag

SEQ ID NO: 921 - DNA, 25 bp, Artificial sequence
  Synthetic oligonucleotide sequence
atttctacaagtcaacctccaattc

SEQ ID NO: 922 - DNA, 25 bp, Artificial sequence
  Synthetic oligonucleotide sequence
agtttcactgagtttgctggctttt

SEQ ID NO: 923 - DNA, 25 bp, Artificial sequence
  Synthetic oligonucleotide sequence
agcctcctacagtgctttagtcata

SEQ ID NO: 924 - DNA, 25 bp, Artificial sequence
  Synthetic oligonucleotide sequence
aaatgctcatacatgttcccttttc

SEQ ID NO: 925 - DNA, 25 bp, Artificial sequence
  Synthetic oligonucleotide sequence
cacataatgctttctttttggtctt

SEQ ID NO: 926 - DNA, 25 bp, Artificial sequence
  Synthetic oligonucleotide sequence
catcatccatgccttatcaatttct

SEQ ID NO: 927 - DNA, 25 bp, Artificial sequence
  Synthetic oligonucleotide sequence
gctatgtgtgaaagagcctcctaca

SEQ ID NO: 928 - DNA, 25 bp, Artificial sequence
  Synthetic oligonucleotide sequence
gagccttaatttcgtccctattgaa

SEQ ID NO: 929 - DNA, 25 bp, Artificial sequence
  Synthetic oligonucleotide sequence
tgcctgcatagacttacccagatgt

SEQ ID NO: 930 - DNA, 25 bp, Artificial sequence
  Synthetic oligonucleotide sequence
tataaaaccggttagtgtcctacag

SEQ ID NO: 931 - DNA, 25 bp, Artificial sequence
  Synthetic oligonucleotide sequence
tatttcccaggagtcagatggccct

SEQ ID NO: 932 - DNA, 25 bp, Artificial sequence
  Synthetic oligonucleotide sequence
atcttggtaacttttatgccttctt

SEQ ID NO: 933 - DNA, 25 bp, Artificial sequence
  Synthetic oligonucleotide sequence
aggccttaatttccatagtacttgc

SEQ ID NO: 934 - DNA, 25 bp, Artificial sequence
  Synthetic oligonucleotide sequence
agtgccgtaatagaccgctgtatag

SEQ ID NO: 935 - DNA, 25 bp, Artificial sequence
  Synthetic oligonucleotide sequence
agttacttctcactgtcagagctgc

SEQ ID NO: 936 - DNA, 25 bp, Artificial sequence
  Synthetic oligonucleotide sequence
acctgtgtgccattttgagagttac

SEQ ID NO: 937 - DNA, 25 bp, Artificial sequence
  Synthetic oligonucleotide sequence
aattcgcctcttagtgaacgtgtga

SEQ ID NO: 938 - DNA, 25 bp, Artificial sequence
  Synthetic oligonucleotide sequence
gcgactcttattttcaggcagtgcc

SEQ ID NO: 939 - DNA, 25 bp, Artificial sequence
  Synthetic oligonucleotide sequence
tgaagcctggtgctttttaccacct

SEQ ID NO: 940 - DNA, 25 bp, Artificial sequence
  Synthetic oligonucleotide sequence
ggcttacgcaacagctgtcacttaa

SEQ ID NO: 941 - DNA, 25 bp, Artificial sequence
  Synthetic oligonucleotide sequence
tttcataccagtcacatccttgttt

SEQ ID NO: 942 - DNA, 25 bp, Artificial sequence
  Synthetic oligonucleotide sequence
tcagagctgcccattttgtttcata

SEQ ID NO: 943 - DNA, 25 bp, Artificial sequence
  Synthetic oligonucleotide sequence
agcatttcatgtgtctagtgtggca

SEQ ID NO: 944 - DNA, 25 bp, Artificial sequence
  Synthetic oligonucleotide sequence
agccacccgatgttgcgtttggaag

SEQ ID NO: 945 - DNA, 25 bp, Artificial sequence
  Synthetic oligonucleotide sequence
acagtatggctgtttgctttgtcct

SEQ ID NO: 946 - DNA, 25 bp, Artificial sequence
  Synthetic oligonucleotide sequence
aaactcgttttgcttctttgtatat

SEQ ID NO: 947 - DNA, 25 bp, Artificial sequence
  Synthetic oligonucleotide sequence
ccaggtgacattctttccaggtaca

SEQ ID NO: 948 - DNA, 25 bp, Artificial sequence
  Synthetic oligonucleotide sequence
gccttgggtttattgtgcacagttt

SEQ ID NO: 949 - DNA, 25 bp, Artificial sequence
  Synthetic oligonucleotide sequence
gcgagatttagtacacctgcacagt

SEQ ID NO: 950 - DNA, 25 bp, Artificial sequence
  Synthetic oligonucleotide sequence
gcacatcctgttcacctgttggtga

SEQ ID NO: 951 - DNA, 25 bp, Artificial sequence
  Synthetic oligonucleotide sequence
gaagtgtttgttgctcccgttggag

SEQ ID NO: 952 - DNA, 25 bp, Artificial sequence
  Synthetic oligonucleotide sequence
ggcgttcttagaaagtaccctgtct

SEQ ID NO: 953 - DNA, 25 bp, Artificial sequence
  Synthetic oligonucleotide sequence
ggcatttctggatgcggctgtcaca

SEQ ID NO: 954 - DNA, 25 bp, Artificial sequence
  Synthetic oligonucleotide sequence
aagtcagatttttgcccatagtgga

SEQ ID NO: 955 - DNA, 25 bp, Artificial sequence
  Synthetic oligonucleotide sequence
aagtgagtccatgacagcttctctg

SEQ ID NO: 956 - DNA, 25 bp, Artificial sequence
  Synthetic oligonucleotide sequence
cacctgccgggatttcatacttaaa

SEQ ID NO: 957 - DNA, 25 bp, Artificial sequence
  Synthetic oligonucleotide sequence
aattcactctcagtttgtaagcccc

SEQ ID NO: 958 - DNA, 25 bp, Artificial sequence
  Synthetic oligonucleotide sequence
gcagacccttcatatcttggatacg

SEQ ID NO: 959 - DNA, 25 bp, Artificial sequence
  Synthetic oligonucleotide sequence
ctgcacaccttacatttcacaattt

SEQ ID NO: 960 - DNA, 25 bp, Artificial sequence
  Synthetic oligonucleotide sequence
cccacgtcaggatcatgtttcttta

SEQ ID NO: 961 - DNA, 25 bp, Artificial sequence
  Synthetic oligonucleotide sequence
gaaaagctacatgccaactaccaga

SEQ ID NO: 962 - DNA, 25 bp, Artificial sequence
  Synthetic oligonucleotide sequence
gtatgtattacctgtctgtcgagga

SEQ ID NO: 963 - DNA, 25 bp, Artificial sequence
  Synthetic oligonucleotide sequence
gtgactgtttgctgtgtatgtgcca

SEQ ID NO: 964 - DNA, 25 bp, Artificial sequence
  Synthetic oligonucleotide sequence
ggagatgctgcataaggccccacgt

SEQ ID NO: 965 - DNA, 25 bp, Artificial sequence
  Synthetic oligonucleotide sequence
ataacctgtttcctctaagatcttg

SEQ ID NO: 966 - DNA, 25 bp, Artificial sequence
  Synthetic oligonucleotide sequence
acagggtgtttccacttgtgtagca

SEQ ID NO: 967 - DNA, 25 bp, Artificial sequence
  Synthetic oligonucleotide sequence
aaaactctactagggctcttgctga

SEQ ID NO: 968 - DNA, 25 bp, Artificial sequence
  Synthetic oligonucleotide sequence
aaaaggcatctttgttctcaacaga

SEQ ID NO: 969 - DNA, 25 bp, Artificial sequence
  Synthetic oligonucleotide sequence
aagcagacgtctctgagcgtttcca

SEQ ID NO: 970 - DNA, 25 bp, Artificial sequence
  Synthetic oligonucleotide sequence
gagcgtttccagtgttttatccaaa

SEQ ID NO: 971 - DNA, 25 bp, Artificial sequence
  Synthetic oligonucleotide sequence
gctgacttcagtgccttttgtaaat

SEQ ID NO: 972 - DNA, 25 bp, Artificial sequence
  Synthetic oligonucleotide sequence
gagattctttctcctcgttaagttt

SEQ ID NO: 973 - DNA, 25 bp, Artificial sequence
  Synthetic oligonucleotide sequence
gaggatgcccaagaccgagcaacag

SEQ ID NO: 974 - DNA, 25 bp, Artificial sequence
  Synthetic oligonucleotide sequence
gattttcctcaacttgctttttggg

SEQ ID NO: 975 - DNA, 25 bp, Artificial sequence
  Synthetic oligonucleotide sequence
taagatcttgctatactgtcctgta

SEQ ID NO: 976 - DNA, 25 bp, Artificial sequence
  Synthetic oligonucleotide sequence
atctatttggttaggcctaggccat

SEQ ID NO: 977 - DNA, 25 bp, Artificial sequence
  Synthetic oligonucleotide sequence
atcgcccctttttattcaacatctg

SEQ ID NO: 978 - DNA, 25 bp, Artificial sequence
  Synthetic oligonucleotide sequence
agtgccctgagtgatgtccagttcc

SEQ ID NO: 979 - DNA, 25 bp, Artificial sequence
  Synthetic oligonucleotide sequence
agtccccatatgtgttaatgtctca

SEQ ID NO: 980 - DNA, 25 bp, Artificial sequence
  Synthetic oligonucleotide sequence
agcgtggactgtgcctgagaccgac

SEQ ID NO: 981 - DNA, 25 bp, Artificial sequence
  Synthetic oligonucleotide sequence
ctaggccatgccttggctgagtata

SEQ ID NO: 982 - DNA, 25 bp, Artificial sequence
  Synthetic oligonucleotide sequence
gtccagttccattagacactctgtc

SEQ ID NO: 983 - DNA, 25 bp, Artificial sequence
  Synthetic oligonucleotide sequence
ggtgactgtgagaaatcgccccttt

SEQ ID NO: 984 - DNA, 25 bp, Artificial sequence
  Synthetic oligonucleotide sequence
tgtacagaggcattcagcgtggact

SEQ ID NO: 985 - DNA, 25 bp, Artificial sequence
  Synthetic oligonucleotide sequence
tagtctgtacgtgaactgctccaag

SEQ ID NO: 986 - DNA, 25 bp, Artificial sequence
  Synthetic oligonucleotide sequence
tttactctgttaggaatcttctcga

SEQ ID NO: 987 - DNA, 25 bp, Artificial sequence
  Synthetic oligonucleotide sequence
aacgtctgacggcagtggtgtcact

SEQ ID NO: 988 - DNA, 25 bp, Artificial sequence
  Synthetic oligonucleotide sequence
cttttcctttgatctggtggctaaa

SEQ ID NO: 989 - DNA, 25 bp, Artificial sequence
  Synthetic oligonucleotide sequence
gcatttccatgtttgagaggcttcc

SEQ ID NO: 990 - DNA, 25 bp, Artificial sequence
  Synthetic oligonucleotide sequence
gcaccttttattgcgcagatgctga

SEQ ID NO: 991 - DNA, 25 bp, Artificial sequence
  Synthetic oligonucleotide sequence
gaggacccttttgttacagcagagc

SEQ ID NO: 992 - DNA, 25 bp, Artificial sequence
  Synthetic oligonucleotide sequence
gaggcttccttttaaatgctttgtc

SEQ ID NO: 993 - DNA, 25 bp, Artificial sequence
  Synthetic oligonucleotide sequence
gtggatgcactctcaaaaaacctca

SEQ ID NO: 994 - DNA, 25 bp, Artificial sequence
  Synthetic oligonucleotide sequence
ggaagagcccggactgcacctttta

SEQ ID NO: 995 - DNA, 25 bp, Artificial sequence
  Synthetic oligonucleotide sequence
ggctacaaacttgatcttttccttt

SEQ ID NO: 996 - DNA, 25 bp, Artificial sequence
  Synthetic oligonucleotide sequence
tggtgtcactgctgtttaactctgc

SEQ ID NO: 997 - DNA, 25 bp, Artificial sequence
  Synthetic oligonucleotide sequence
ttaactctgcgagctgtttccacat

SEQ ID NO: 998 - DNA, 25 bp, Artificial sequence
  Synthetic oligonucleotide sequence
atgtacctgctgatcatcactgtgt

SEQ ID NO: 999 - DNA, 25 bp, Artificial sequence
  Synthetic oligonucleotide sequence
aaatctttcaataacctgccagtgg

SEQ ID NO: 1000 - DNA, 25 bp, Artificial sequence
  Synthetic oligonucleotide sequence
gaccgtcctgactgtatattttcaa

SEQ ID NO: 1001 - DNA, 25 bp, Artificial sequence
  Synthetic oligonucleotide sequence
gacgttgtctgtgatggtgtccacg

SEQ ID NO: 1002 - DNA, 25 bp, Artificial sequence
  Synthetic oligonucleotide sequence
gagatcatgcttgcgttactaggac

SEQ ID NO: 1003 - DNA, 25 bp, Artificial sequence
  Synthetic oligonucleotide sequence
gtctgagcctcatgtacctatttga

SEQ ID NO: 1004 - DNA, 25 bp, Artificial sequence
  Synthetic oligonucleotide sequence
gtattctgactctaacatggacttt

SEQ ID NO: 1005 - DNA, 25 bp, Artificial sequence
  Synthetic oligonucleotide sequence
ggatatgctcactgatctgtgctta

SEQ ID NO: 1006 - DNA, 25 bp, Artificial sequence
  Synthetic oligonucleotide sequence
tcagccttgctggatttggagtctt

SEQ ID NO: 1007 - DNA, 25 bp, Artificial sequence
  Synthetic oligonucleotide sequence
ttgtacatctcactgcttagcttag

SEQ ID NO: 1008 - DNA, 25 bp, Artificial sequence
  Synthetic oligonucleotide sequence
ttctcttcaggtgcagccttactgg

SEQ ID NO: 1009 - DNA, 25 bp, Artificial sequence
  Synthetic oligonucleotide sequence
agctcaggcccgatctgcttgggaa

SEQ ID NO: 1010 - DNA, 25 bp, Artificial sequence
  Synthetic oligonucleotide sequence
agcccatctctctgaagggatttat

SEQ ID NO: 1011 - DNA, 25 bp, Artificial sequence
  Synthetic oligonucleotide sequence
aattcctggctctctttatgttctg

SEQ ID NO: 1012 - DNA, 25 bp, Artificial sequence
  Synthetic oligonucleotide sequence
gccgcttactgctgcgtgaactaat

SEQ ID NO: 1013 - DNA, 25 bp, Artificial sequence
  Synthetic oligonucleotide sequence
gaattgcaggaaagcccatctctct

SEQ ID NO: 1014 - DNA, 25 bp, Artificial sequence
  Synthetic oligonucleotide sequence
gaaggtggcattccatcagcagaag

SEQ ID NO: 1015 - DNA, 25 bp, Artificial sequence
  Synthetic oligonucleotide sequence
gtagccatctattcagcctatatca

SEQ ID NO: 1016 - DNA, 25 bp, Artificial sequence
  Synthetic oligonucleotide sequence
gtgaactaatcttttccacctctct

SEQ ID NO: 1017 - DNA, 25 bp, Artificial sequence
  Synthetic oligonucleotide sequence
tggtgtgggaccctgagactacact

SEQ ID NO: 1018 - DNA, 25 bp, Artificial sequence
  Synthetic oligonucleotide sequence
tcatgatatcctctaatccttccaa

SEQ ID NO: 1019 - DNA, 25 bp, Artificial sequence
  Synthetic oligonucleotide sequence
ttaattctgtgctctctctatatgg

SEQ ID NO: 1020 - DNA, 25 bp, Artificial sequence
  Synthetic oligonucleotide sequence
atccttgctgcagactttgaaattg

SEQ ID NO: 1021 - DNA, 25 bp, Artificial sequence
  Synthetic oligonucleotide sequence
aacagtttccaatgactctttcttt

SEQ ID NO: 1022 - DNA, 25 bp, Artificial sequence
  Synthetic oligonucleotide sequence
tacgtgagcgtataatcccaagatc

SEQ ID NO: 1023 - DNA, 25 bp, Artificial sequence
  Synthetic oligonucleotide sequence
gatgctgaagctatccttgctgcag

SEQ ID NO: 1024 - DNA, 25 bp, Artificial sequence
  Synthetic oligonucleotide sequence
gattctgatcccttttcttttgatg

SEQ ID NO: 1025 - DNA, 25 bp, Artificial sequence
  Synthetic oligonucleotide sequence
gttgttgtttgtttgtttgcttgct

SEQ ID NO: 1026 - DNA, 25 bp, Artificial sequence
  Synthetic oligonucleotide sequence
gtgggacagttcgtactgtgaccaa

SEQ ID NO: 1027 - DNA, 25 bp, Artificial sequence
  Synthetic oligonucleotide sequence
ggtcttctgcttccctggaaaggat

SEQ ID NO: 1028 - DNA, 25 bp, Artificial sequence
  Synthetic oligonucleotide sequence
tgaggataacctgcactggtcttct

SEQ ID NO: 1029 - DNA, 25 bp, Artificial sequence
  Synthetic oligonucleotide sequence
tgcttgcttttgtttttgcagccta

SEQ ID NO: 1030 - DNA, 25 bp, Artificial sequence
  Synthetic oligonucleotide sequence
ttgcccctcctgaagttcctgagag

SEQ ID NO: 1031 - DNA, 25 bp, Artificial sequence
  Synthetic oligonucleotide sequence
atccgagccctacgctcaggtggtg

SEQ ID NO: 1032 - DNA, 25 bp, Artificial sequence
  Synthetic oligonucleotide sequence
aggtggtgccttaagacgccaagga

SEQ ID NO: 1033 - DNA, 25 bp, Artificial sequence
  Synthetic oligonucleotide sequence
agctctcatactcttcagaattctc

SEQ ID NO: 1034 - DNA, 25 bp, Artificial sequence
  Synthetic oligonucleotide sequence
aagactgatgattccttcctgaaga

SEQ ID NO: 1035 - DNA, 25 bp, Artificial sequence
  Synthetic oligonucleotide sequence
gatgattccttcctgaagatcagtt

SEQ ID NO: 1036 - DNA, 25 bp, Artificial sequence
  Synthetic oligonucleotide sequence
tgtctccatggaagcaataattctc

SEQ ID NO: 1037 - DNA, 25 bp, Artificial sequence
  Synthetic oligonucleotide sequence
tgctagatgacctcgcactatttac

SEQ ID NO: 1038 - DNA, 25 bp, Artificial sequence
  Synthetic oligonucleotide sequence
tagggacctgatccatgtctccatg

SEQ ID NO: 1039 - DNA, 25 bp, Artificial sequence
  Synthetic oligonucleotide sequence
taatctctagggacctgatccatgt

SEQ ID NO: 1040 - DNA, 25 bp, Artificial sequence
  Synthetic oligonucleotide sequence
tacgctcaggtggtgccttaagacg

SEQ ID NO: 1041 - DNA, 25 bp, Artificial sequence
  Synthetic oligonucleotide sequence
ttttcctccccaagactgatgattc

SEQ ID NO: 1042 - DNA, 25 bp, Artificial sequence
  Synthetic oligonucleotide sequence
agaggatctctcttttgaaaagcta

SEQ ID NO: 1043 - DNA, 25 bp, Artificial sequence
  Synthetic oligonucleotide sequence
aagaacacttacagctcatatacag

SEQ ID NO: 1044 - DNA, 25 bp, Artificial sequence
  Synthetic oligonucleotide sequence
aaggagtttcctgtggtttctgccg

SEQ ID NO: 1045 - DNA, 25 bp, Artificial sequence
  Synthetic oligonucleotide sequence
cgactattactttctctcaagtgcc

SEQ ID NO: 1046 - DNA, 25 bp, Artificial sequence
  Synthetic oligonucleotide sequence
gaatatgttctcctttgtagcctct

SEQ ID NO: 1047 - DNA, 25 bp, Artificial sequence
  Synthetic oligonucleotide sequence
gaaaaacacagcttagccccttcct

SEQ ID NO: 1048 - DNA, 25 bp, Artificial sequence
  Synthetic oligonucleotide sequence
gtagaatgacaccaaagctgcaact

SEQ ID NO: 1049 - DNA, 25 bp, Artificial sequence
  Synthetic oligonucleotide sequence
ggaaatcagtcagtaccatcgttaa

SEQ ID NO: 1050 - DNA, 25 bp, Artificial sequence
  Synthetic oligonucleotide sequence
ttgtagcctcttgacaaagcaggaa

SEQ ID NO: 1051 - DNA, 25 bp, Artificial sequence
  Synthetic oligonucleotide sequence
ttgtccactgaaactttgctaacgt

SEQ ID NO: 1052 - DNA, 25 bp, Artificial sequence
  Synthetic oligonucleotide sequence
ttcctctagccttcagtcaattttt

SEQ ID NO: 1053 - DNA, 25 bp, Artificial sequence
  Synthetic oligonucleotide sequence
atgtatgcgtgagaaggccccgtga

SEQ ID NO: 1054 - DNA, 25 bp, Artificial sequence
  Synthetic oligonucleotide sequence
atttatttttggttctctgctgtaa

SEQ ID NO: 1055 - DNA, 25 bp, Artificial sequence
  Synthetic oligonucleotide sequence
aggccccgtgatataatagtgctta

SEQ ID NO: 1056 - DNA, 25 bp, Artificial sequence
  Synthetic oligonucleotide sequence
accacacttctgttgtcttttcaaa

SEQ ID NO: 1057 - DNA, 25 bp, Artificial sequence
  Synthetic oligonucleotide sequence
gttacctgcctccagagttctaaaa

SEQ ID NO: 1058 - DNA, 25 bp, Artificial sequence
  Synthetic oligonucleotide sequence
gtatgctcagcacctaatgcacata

SEQ ID NO: 1059 - DNA, 25 bp, Artificial sequence
  Synthetic oligonucleotide sequence
gtattttcaaacagcttttcaggat

SEQ ID NO: 1060 - DNA, 25 bp, Artificial sequence
  Synthetic oligonucleotide sequence
tctgttgtaattgcgtgtctgtcct

SEQ ID NO: 1061 - DNA, 25 bp, Artificial sequence
  Synthetic oligonucleotide sequence
taaaatcacctttactgacggttgt

SEQ ID NO: 1062 - DNA, 25 bp, Artificial sequence
  Synthetic oligonucleotide sequence
tagtgcttagcattctctgttgtaa

SEQ ID NO: 1063 - DNA, 25 bp, Artificial sequence
  Synthetic oligonucleotide sequence
tttcctcttgtccttaaactccata

SEQ ID NO: 1064 - DNA, 25 bp, Artificial sequence
  Synthetic oligonucleotide sequence
ctaacatttgtatggaccccttcat

SEQ ID NO: 1065 - DNA, 25 bp, Artificial sequence
  Synthetic oligonucleotide sequence
cagcaggactgattgccgggtgcaa

SEQ ID NO: 1066 - DNA, 25 bp, Artificial sequence
  Synthetic oligonucleotide sequence
accgtttttgtcctaatgcttctgt

SEQ ID NO: 1067 - DNA, 25 bp, Artificial sequence
  Synthetic oligonucleotide sequence
acctctctgccaaacgtgatcttaa

SEQ ID NO: 1068 - DNA, 25 bp, Artificial sequence
  Synthetic oligonucleotide sequence
aaatcacaccatccagactgacaat

SEQ ID NO: 1069 - DNA, 25 bp, Artificial sequence
  Synthetic oligonucleotide sequence
aacaactctctttttggcagcaact

SEQ ID NO: 1070 - DNA, 25 bp, Artificial sequence
  Synthetic oligonucleotide sequence
aagccacaccgtcgtctgtgagaaa

SEQ ID NO: 1071 - DNA, 25 bp, Artificial sequence
  Synthetic oligonucleotide sequence
ctttgctccatttcattttgccaga

SEQ ID NO: 1072 - DNA, 25 bp, Artificial sequence
  Synthetic oligonucleotide sequence
gagaaagtgcgcctccttaaagggt

SEQ ID NO: 1073 - DNA, 25 bp, Artificial sequence
  Synthetic oligonucleotide sequence
gcttctgttttatgtggtgatcgca

SEQ ID NO: 1074 - DNA, 25 bp, Artificial sequence
  Synthetic oligonucleotide sequence
taaagtgttcgttgtggtggccgtc

SEQ ID NO: 1075 - DNA, 25 bp, Artificial sequence
  Synthetic oligonucleotide sequence
atagtgtgcagttagcgtggtcccc

SEQ ID NO: 1076 - DNA, 25 bp, Artificial sequence
  Synthetic oligonucleotide sequence
aggctcttctgtgcttctatgatat

SEQ ID NO: 1077 - DNA, 25 bp, Artificial sequence
  Synthetic oligonucleotide sequence
agtgccttgttctgatttttgttct

SEQ ID NO: 1078 - DNA, 25 bp, Artificial sequence
  Synthetic oligonucleotide sequence
agaggcagcctttccagagcaaatc

SEQ ID NO: 1079 - DNA, 25 bp, Artificial sequence
  Synthetic oligonucleotide sequence
aagtcgtcacgatcgcgagagttga

SEQ ID NO: 1080 - DNA, 25 bp, Artificial sequence
  Synthetic oligonucleotide sequence
ctgtctctttatgtgtgcggtttat

SEQ ID NO: 1081 - DNA, 25 bp, Artificial sequence
  Synthetic oligonucleotide sequence
cccgctgcctgtactgaatagtgtg

SEQ ID NO: 1082 - DNA, 25 bp, Artificial sequence
  Synthetic oligonucleotide sequence
gtatcttccgtttgaattccctttg

SEQ ID NO: 1083 - DNA, 25 bp, Artificial sequence
  Synthetic oligonucleotide sequence
gtgcctgggcagatgtagtttctcc

SEQ ID NO: 1084 - DNA, 25 bp, Artificial sequence
  Synthetic oligonucleotide sequence
tgctttgcctttttcgttctgtaaa

SEQ ID NO: 1085 - DNA, 25 bp, Artificial sequence
  Synthetic oligonucleotide sequence
tttaataaactcctcctgtctcttt

SEQ ID NO: 1086 - DNA, 25 bp, Artificial sequence
  Synthetic oligonucleotide sequence
atgcagatcagatggcgtttctccc

SEQ ID NO: 1087 - DNA, 25 bp, Artificial sequence
  Synthetic oligonucleotide sequence
acgtgttcagacttgtgttttcata

SEQ ID NO: 1088 - DNA, 25 bp, Artificial sequence
  Synthetic oligonucleotide sequence
aagtatgggctgtttcacgtgttca

SEQ ID NO: 1089 - DNA, 25 bp, Artificial sequence
  Synthetic oligonucleotide sequence
gactatgtactgtccacctgcatta

SEQ ID NO: 1090 - DNA, 25 bp, Artificial sequence
  Synthetic oligonucleotide sequence
gattgatttcctactagtctttgac

SEQ ID NO: 1091 - DNA, 25 bp, Artificial sequence
  Synthetic oligonucleotide sequence
gtttctcccagctcagtggattttc

SEQ ID NO: 1092 - DNA, 25 bp, Artificial sequence
  Synthetic oligonucleotide sequence
ggagcctggcttatttgattgattt

SEQ ID NO: 1093 - DNA, 25 bp, Artificial sequence
  Synthetic oligonucleotide sequence
ggaagtccctgttctgactatgtac

SEQ ID NO: 1094 - DNA, 25 bp, Artificial sequence
  Synthetic oligonucleotide sequence
tcccttcattctggtttccatgtga

SEQ ID NO: 1095 - DNA, 25 bp, Artificial sequence
  Synthetic oligonucleotide sequence
tcaccaactcccttttggatttcat

SEQ ID NO: 1096 - DNA, 25 bp, Artificial sequence
  Synthetic oligonucleotide sequence
taaacaaccatgtctgcatctaggg

SEQ ID NO: 1097 - DNA, 25 bp, Artificial sequence
  Synthetic oligonucleotide sequence
atgatgtgtgtatcttcctgggaaa

SEQ ID NO: 1098 - DNA, 25 bp, Artificial sequence
  Synthetic oligonucleotide sequence
actgtgctgcttttcatgtgtagga

SEQ ID NO: 1099 - DNA, 25 bp, Artificial sequence
  Synthetic oligonucleotide sequence
gaatgcttctgggagtgatgcttca

SEQ ID NO: 1100 - DNA, 25 bp, Artificial sequence
  Synthetic oligonucleotide sequence
gaagaagatccctacctggtggtta

SEQ ID NO: 1101 - DNA, 25 bp, Artificial sequence
  Synthetic oligonucleotide sequence
gagtctgcatggagctctcctagag

SEQ ID NO: 1102 - DNA, 25 bp, Artificial sequence
  Synthetic oligonucleotide sequence
gttaaccctaactacctgcttgaag

SEQ ID NO: 1103 - DNA, 25 bp, Artificial sequence
  Synthetic oligonucleotide sequence
gtttctgtcatacgcttttatacca

SEQ ID NO: 1104 - DNA, 25 bp, Artificial sequence
  Synthetic oligonucleotide sequence
ggatggttgtgtcatgtttctgtca

SEQ ID NO: 1105 - DNA, 25 bp, Artificial sequence
  Synthetic oligonucleotide sequence
ggctttagccctttgtttactgtgc

SEQ ID NO: 1106 - DNA, 25 bp, Artificial sequence
  Synthetic oligonucleotide sequence
tcacccactacgatcatgttctaat

SEQ ID NO: 1107 - DNA, 25 bp, Artificial sequence
  Synthetic oligonucleotide sequence
taacccgagaaactgcagcctgctg

SEQ ID NO: 1108 - DNA, 25 bp, Artificial sequence
  Synthetic oligonucleotide sequence
aggagaccttccgagttacagcaac

SEQ ID NO: 1109 - DNA, 25 bp, Artificial sequence
  Synthetic oligonucleotide sequence
acacacgtcctgttatgtgcatgaa

SEQ ID NO: 1110 - DNA, 25 bp, Artificial sequence
  Synthetic oligonucleotide sequence
aaagcctcgttgctgtaccaggaga

SEQ ID NO: 1111 - DNA, 25 bp, Artificial sequence
  Synthetic oligonucleotide sequence
aaacctgcatggaagcctagtgtat

SEQ ID NO: 1112 - DNA, 25 bp, Artificial sequence
  Synthetic oligonucleotide sequence
gaatcggaacatcttttcccatggg

SEQ ID NO: 1113 - DNA, 25 bp, Artificial sequence
  Synthetic oligonucleotide sequence
gatgctttcagcagaactgtcttgc

SEQ ID NO: 1114 - DNA, 25 bp, Artificial sequence
  Synthetic oligonucleotide sequence
gtaacttttactcctcttgacaagc

SEQ ID NO: 1115 - DNA, 25 bp, Artificial sequence
  Synthetic oligonucleotide sequence
tgtccacactgtaactctcattatg

SEQ ID NO: 1116 - DNA, 25 bp, Artificial sequence
  Synthetic oligonucleotide sequence
tgcaggcacctcagactcaagtgga

SEQ ID NO: 1117 - DNA, 25 bp, Artificial sequence
  Synthetic oligonucleotide sequence
ttgattcacatgcatgcaggcacct

SEQ ID NO: 1118 - DNA, 25 bp, Artificial sequence
  Synthetic oligonucleotide sequence
ttgctgcggcactttgttttaacat

SEQ ID NO: 1119 - DNA, 25 bp, Artificial sequence
  Synthetic oligonucleotide sequence
atgctacctttttaggttgtcctga

SEQ ID NO: 1120 - DNA, 25 bp, Artificial sequence
  Synthetic oligonucleotide sequence
aagttggtacagttattttcctcat

SEQ ID NO: 1121 - DNA, 25 bp, Artificial sequence
  Synthetic oligonucleotide sequence
aatacccgtattttagttgtcatag

SEQ ID NO: 1122 - DNA, 25 bp, Artificial sequence
  Synthetic oligonucleotide sequence
cggtgtgactttgcttaggtttctc

SEQ ID NO: 1123 - DNA, 25 bp, Artificial sequence
  Synthetic oligonucleotide sequence
gccatctttggccaagtgttaggag

SEQ ID NO: 1124 - DNA, 25 bp, Artificial sequence
  Synthetic oligonucleotide sequence
gagttttggctttgtagtcaggcaa

SEQ ID NO: 1125 - DNA, 25 bp, Artificial sequence
  Synthetic oligonucleotide sequence
gtcaggcaagcctatgttgggtcct

SEQ ID NO: 1126 - DNA, 25 bp, Artificial sequence
  Synthetic oligonucleotide sequence
gtgtattctcttactcttgagcttt

SEQ ID NO: 1127 - DNA, 25 bp, Artificial sequence
  Synthetic oligonucleotide sequence
ggctgttgccacttaatagcggtgt

SEQ ID NO: 1128 - DNA, 25 bp, Artificial sequence
  Synthetic oligonucleotide sequence
tgagcctcattatccacatctgtaa

SEQ ID NO: 1129 - DNA, 25 bp, Artificial sequence
  Synthetic oligonucleotide sequence
ttaggtttctcaacttcgctgagcc

SEQ ID NO: 1130 - DNA, 25 bp, Artificial sequence
  Synthetic oligonucleotide sequence
attatgagcgggtcacagcagccct

SEQ ID NO: 1131 - DNA, 25 bp, Artificial sequence
  Synthetic oligonucleotide sequence
atcatgtagcagaacggcacccaga

SEQ ID NO: 1132 - DNA, 25 bp, Artificial sequence
  Synthetic oligonucleotide sequence
agagcctcagtcttgctgatttcaa

SEQ ID NO: 1133 - DNA, 25 bp, Artificial sequence
  Synthetic oligonucleotide sequence
gccatcagttagctatcagactcta

SEQ ID NO: 1134 - DNA, 25 bp, Artificial sequence
  Synthetic oligonucleotide sequence
gcggagccagcatttgaaccttgta

SEQ ID NO: 1135 - DNA, 25 bp, Artificial sequence
  Synthetic oligonucleotide sequence
gacattttctttgctctgtttgtag

SEQ ID NO: 1136 - DNA, 25 bp, Artificial sequence
  Synthetic oligonucleotide sequence
gagatcgtgaattccagcccgcgga

SEQ ID NO: 1137 - DNA, 25 bp, Artificial sequence
  Synthetic oligonucleotide sequence
gattcttgcacatgaactgtcacac

SEQ ID NO: 1138 - DNA, 25 bp, Artificial sequence
  Synthetic oligonucleotide sequence
gtttgtgttctgtaaatcctctgtt

SEQ ID NO: 1139 - DNA, 25 bp, Artificial sequence
  Synthetic oligonucleotide sequence
ggaggatctactgctgtacagctaa

SEQ ID NO: 1140 - DNA, 25 bp, Artificial sequence
  Synthetic oligonucleotide sequence
tgatttcccatcgacattttctttg

SEQ ID NO: 1141 - DNA, 25 bp, Artificial sequence
  Synthetic oligonucleotide sequence
atgtcttggattgcactttcgtgga

SEQ ID NO: 1142 - DNA, 25 bp, Artificial sequence
  Synthetic oligonucleotide sequence
agttggtggctccagtttgcttttc

SEQ ID NO: 1143 - DNA, 25 bp, Artificial sequence
  Synthetic oligonucleotide sequence
agcagccttggtcgttttcgttgga

SEQ ID NO: 1144 - DNA, 25 bp, Artificial sequence
  Synthetic oligonucleotide sequence
agctcatctcaatgtcctgttgact

SEQ ID NO: 1145 - DNA, 25 bp, Artificial sequence
  Synthetic oligonucleotide sequence
ggttttgattcctctgctaggacgc

SEQ ID NO: 1146 - DNA, 25 bp, Artificial sequence
  Synthetic oligonucleotide sequence
gaaatctttggttttgtcctgtgag

SEQ ID NO: 1147 - DNA, 25 bp, Artificial sequence
  Synthetic oligonucleotide sequence
gtagatcaccgaaactaacttgctg

SEQ ID NO: 1148 - DNA, 25 bp, Artificial sequence
  Synthetic oligonucleotide sequence
gtcctgtgagaccagtgcttgacat

SEQ ID NO: 1149 - DNA, 25 bp, Artificial sequence
  Synthetic oligonucleotide sequence
tgcttgacatcgtctgttcgcctga

SEQ ID NO: 1150 - DNA, 25 bp, Artificial sequence
  Synthetic oligonucleotide sequence
taggacgctgcctaaaccagctcat

SEQ ID NO: 1151 - DNA, 25 bp, Artificial sequence
  Synthetic oligonucleotide sequence
tttctcttcggtctcgtggtagcag

SEQ ID NO: 1152 - DNA, 25 bp, Artificial sequence
  Synthetic oligonucleotide sequence
aatttaacctcactggattggcacc

SEQ ID NO: 1153 - DNA, 25 bp, Artificial sequence
  Synthetic oligonucleotide sequence
atcagggcattcttatgtgaacttg

SEQ ID NO: 1154 - DNA, 25 bp, Artificial sequence
  Synthetic oligonucleotide sequence
attaggccagattctgcccagttag

SEQ ID NO: 1155 - DNA, 25 bp, Artificial sequence
  Synthetic oligonucleotide sequence
agattgctggataacatgactttca

SEQ ID NO: 1156 - DNA, 25 bp, Artificial sequence
  Synthetic oligonucleotide sequence
aaatgatggcatttcagattgctgg

SEQ ID NO: 1157 - DNA, 25 bp, Artificial sequence
  Synthetic oligonucleotide sequence
gcccagttagatattttgcacagtt

SEQ ID NO: 1158 - DNA, 25 bp, Artificial sequence
  Synthetic oligonucleotide sequence
gaacacagctcccaattaggccaga

SEQ ID NO: 1159 - DNA, 25 bp, Artificial sequence
  Synthetic oligonucleotide sequence
gtacctgcaatgtttactttcagtt

SEQ ID NO: 1160 - DNA, 25 bp, Artificial sequence
  Synthetic oligonucleotide sequence
ggaacattagttctttcttattcag

SEQ ID NO: 1161 - DNA, 25 bp, Artificial sequence
  Synthetic oligonucleotide sequence
ttggcacctccccaggaaaatcagg

SEQ ID NO: 1162 - DNA, 25 bp, Artificial sequence
  Synthetic oligonucleotide sequence
ttgtggtttgtctgtaccaggccat

SEQ ID NO: 1163 - DNA, 25 bp, Artificial sequence
  Synthetic oligonucleotide sequence
atatatgctgtctgttttgtgtaca

SEQ ID NO: 1164 - DNA, 25 bp, Artificial sequence
  Synthetic oligonucleotide sequence
aactcactcttacagtagtctgctt

SEQ ID NO: 1165 - DNA, 25 bp, Artificial sequence
  Synthetic oligonucleotide sequence
aatgttgtcttttaaatactccgat

SEQ ID NO: 1166 - DNA, 25 bp, Artificial sequence
  Synthetic oligonucleotide sequence
caagccatttgtgggaatcctaaaa

SEQ ID NO: 1167 - DNA, 25 bp, Artificial sequence
  Synthetic oligonucleotide sequence
ccagctgtttattttattgagtcct

SEQ ID NO: 1168 - DNA, 25 bp, Artificial sequence
  Synthetic oligonucleotide sequence
gagtaacaaactcagccttctgtaa

SEQ ID NO: 1169 - DNA, 25 bp, Artificial sequence
  Synthetic oligonucleotide sequence
gaggatcatctgacttttcacttac

SEQ ID NO: 1170 - DNA, 25 bp, Artificial sequence
  Synthetic oligonucleotide sequence
gtagtctgcttatttccagctgttt

SEQ ID NO: 1171 - DNA, 25 bp, Artificial sequence
  Synthetic oligonucleotide sequence
gtgctttatgtactgttatcctata

SEQ ID NO: 1172 - DNA, 25 bp, Artificial sequence
  Synthetic oligonucleotide sequence
tgtaaaaactccttttctgccacac

SEQ ID NO: 1173 - DNA, 25 bp, Artificial sequence
  Synthetic oligonucleotide sequence
ttgggttttcttttcaactcactct

SEQ ID NO: 1174 - DNA, 25 bp, Artificial sequence
  Synthetic oligonucleotide sequence
atgtaaagctctgtgtccgaaacca

SEQ ID NO: 1175 - DNA, 25 bp, Artificial sequence
  Synthetic oligonucleotide sequence
agtttatccactttaccatctcttt

SEQ ID NO: 1176 - DNA, 25 bp, Artificial sequence
  Synthetic oligonucleotide sequence
aaaaatcatgcagtgtctcccaaag

SEQ ID NO: 1177 - DNA, 25 bp, Artificial sequence
  Synthetic oligonucleotide sequence
gctgtataagctgtctctggagatc

SEQ ID NO: 1178 - DNA, 25 bp, Artificial sequence
  Synthetic oligonucleotide sequence
gaaaaatgtaccttgctgccttcaa

SEQ ID NO: 1179 - DNA, 25 bp, Artificial sequence
  Synthetic oligonucleotide sequence
gacggctgtctgtggttaaggatca

SEQ ID NO: 1180 - DNA, 25 bp, Artificial sequence
  Synthetic oligonucleotide sequence
gtgacatgtttttgctttcctggac

SEQ ID NO: 1181 - DNA, 25 bp, Artificial sequence
  Synthetic oligonucleotide sequence
ggttggtctccaaagtatcacttgc

SEQ ID NO: 1182 - DNA, 25 bp, Artificial sequence
  Synthetic oligonucleotide sequence
tgagaacggccctggagctgtataa

SEQ ID NO: 1183 - DNA, 25 bp, Artificial sequence
  Synthetic oligonucleotide sequence
tgaccctcactatcgtttggttggt

SEQ ID NO: 1184 - DNA, 25 bp, Artificial sequence
  Synthetic oligonucleotide sequence
ttttgtgccatcactcctggtaata

SEQ ID NO: 1185 - DNA, 25 bp, Artificial sequence
  Synthetic oligonucleotide sequence
atgaccgtcgtcgtgagcgagatga

SEQ ID NO: 1186 - DNA, 25 bp, Artificial sequence
  Synthetic oligonucleotide sequence
atggatggaccacggtacgacgtta

SEQ ID NO: 1187 - DNA, 25 bp, Artificial sequence
  Synthetic oligonucleotide sequence
agattgatcatgcaccgtatccaca

SEQ ID NO: 1188 - DNA, 25 bp, Artificial sequence
  Synthetic oligonucleotide sequence
agttcttggagacgtgctgatgaca

SEQ ID NO: 1189 - DNA, 25 bp, Artificial sequence
  Synthetic oligonucleotide sequence
acataggtttgatcacattcgcgga

SEQ ID NO: 1190 - DNA, 25 bp, Artificial sequence
  Synthetic oligonucleotide sequence
aagaggacctcctttgagatcagaa

SEQ ID NO: 1191 - DNA, 25 bp, Artificial sequence
  Synthetic oligonucleotide sequence
cgcggattattagacttgtgcttca

SEQ ID NO: 1192 - DNA, 25 bp, Artificial sequence
  Synthetic oligonucleotide sequence
gagagattcgagtcgccgtgacgat

SEQ ID NO: 1193 - DNA, 25 bp, Artificial sequence
  Synthetic oligonucleotide sequence
gatagggaatctcttcgtcgtacta

SEQ ID NO: 1194 - DNA, 25 bp, Artificial sequence
  Synthetic oligonucleotide sequence
ggattctttaatgttgtctcaccat

SEQ ID NO: 1195 - DNA, 25 bp, Artificial sequence
  Synthetic oligonucleotide sequence
tgggttcgaactcatgtgtcacata

SEQ ID NO: 1196 - DNA, 25 bp, Artificial sequence
  Synthetic oligonucleotide sequence
atggcaatcacagctcgcctgggat

SEQ ID NO: 1197 - DNA, 25 bp, Artificial sequence
  Synthetic oligonucleotide sequence
aggtcaaatcctcacgatgcacagc

SEQ ID NO: 1198 - DNA, 25 bp, Artificial sequence
  Synthetic oligonucleotide sequence
acagtgcggtgatgcatgcgctcca

SEQ ID NO: 1199 - DNA, 25 bp, Artificial sequence
  Synthetic oligonucleotide sequence
aaagctacttccagtgttggctatg

SEQ ID NO: 1200 - DNA, 25 bp, Artificial sequence
  Synthetic oligonucleotide sequence
aaggcctcatctcctttatatgcag

SEQ ID NO: 1201 - DNA, 25 bp, Artificial sequence
  Synthetic oligonucleotide sequence
aaggtgtttccatttctccatcaca

SEQ ID NO: 1202 - DNA, 25 bp, Artificial sequence
  Synthetic oligonucleotide sequence
catctcctgatttctctgaacggaa

SEQ ID NO: 1203 - DNA, 25 bp, Artificial sequence
  Synthetic oligonucleotide sequence
ctgaactcagctggagcctgtggaa

SEQ ID NO: 1204 - DNA, 25 bp, Artificial sequence
  Synthetic oligonucleotide sequence
gaagagctccttggtttctgagcat

SEQ ID NO: 1205 - DNA, 25 bp, Artificial sequence
  Synthetic oligonucleotide sequence
gaccctgggtcaactggagtgagaa

SEQ ID NO: 1206 - DNA, 25 bp, Artificial sequence
  Synthetic oligonucleotide sequence
gagggcccacatatttaaatcttct

SEQ ID NO: 1207 - DNA, 25 bp, Artificial sequence
  Synthetic oligonucleotide sequence
tgatcgttcacaagcgtactcacgc

SEQ ID NO: 1208 - DNA, 25 bp, Artificial sequence
  Synthetic oligonucleotide sequence
gcagttttttgtacttgatcgttca

SEQ ID NO: 1209 - DNA, 25 bp, Artificial sequence
  Synthetic oligonucleotide sequence
gaatgtggtaaagccctcagttgtc

SEQ ID NO: 1210 - DNA, 25 bp, Artificial sequence
  Synthetic oligonucleotide sequence
gtactcacgctggagagaaacctta

SEQ ID NO: 1211 - DNA, 25 bp, Artificial sequence
  Synthetic oligonucleotide sequence
gaaccacactggagagatgctctag

SEQ ID NO: 1212 - DNA, 25 bp, Artificial sequence
  Synthetic oligonucleotide sequence
gaaacatgggaagcccttcactgtt

SEQ ID NO: 1213 - DNA, 25 bp, Artificial sequence
  Synthetic oligonucleotide sequence
gagaatctcatcacaacctggcatg

SEQ ID NO: 1214 - DNA, 25 bp, Artificial sequence
  Synthetic oligonucleotide sequence
gtaccatgaaagcacttacctgcag

SEQ ID NO: 1215 - DNA, 25 bp, Artificial sequence
  Synthetic oligonucleotide sequence
tcagttgtcccaattcactttgaag

SEQ ID NO: 1216 - DNA, 25 bp, Artificial sequence
  Synthetic oligonucleotide sequence
ttcccatttccttttggtaccatga

SEQ ID NO: 1217 - DNA, 25 bp, Artificial sequence
  Synthetic oligonucleotide sequence
ttacctgcagagaaatcctgtcagt

SEQ ID NO: 1218 - DNA, 25 bp, Artificial sequence
  Synthetic oligonucleotide sequence
agttccccttcaaggagccagagag

SEQ ID NO: 1219 - DNA, 25 bp, Artificial sequence
  Synthetic oligonucleotide sequence
accagcagctggaagcaccaagtat

SEQ ID NO: 1220 - DNA, 25 bp, Artificial sequence
  Synthetic oligonucleotide sequence
aacacactgatttcttcttgggtcc

SEQ ID NO: 1221 - DNA, 25 bp, Artificial sequence
  Synthetic oligonucleotide sequence
ctgagcttcagcacactggcagaga

SEQ ID NO: 1222 - DNA, 25 bp, Artificial sequence
  Synthetic oligonucleotide sequence
cgatcagagctgtccctcaaggagg

SEQ ID NO: 1223 - DNA, 25 bp, Artificial sequence
  Synthetic oligonucleotide sequence
gagttttatcagcagaattccctaa

SEQ ID NO: 1224 - DNA, 25 bp, Artificial sequence
  Synthetic oligonucleotide sequence
gaggagaaactccaggctctgagcc

SEQ ID NO: 1225 - DNA, 25 bp, Artificial sequence
  Synthetic oligonucleotide sequence
gattattctgaatactgctgagctt

SEQ ID NO: 1226 - DNA, 25 bp, Artificial sequence
  Synthetic oligonucleotide sequence
gattgtttcaagtcgctggacacca

SEQ ID NO: 1227 - DNA, 25 bp, Artificial sequence
  Synthetic oligonucleotide sequence
gggtgatgccttgtcatggttaatt

SEQ ID NO: 1228 - DNA, 25 bp, Artificial sequence
  Synthetic oligonucleotide sequence
ggagagccattagcaaaccagcagc

SEQ ID NO: 1229 - DNA, 25 bp, Artificial sequence
  Synthetic oligonucleotide sequence
agagtgtccgtttgtacacgccaaa

SEQ ID NO: 1230 - DNA, 25 bp, Artificial sequence
  Synthetic oligonucleotide sequence
agatgagcagttacacgcgacggat

SEQ ID NO: 1231 - DNA, 25 bp, Artificial sequence
  Synthetic oligonucleotide sequence
ctggactctgatctagctcaatgat

SEQ ID NO: 1232 - DNA, 25 bp, Artificial sequence
  Synthetic oligonucleotide sequence
gcctttctatgactgctttggttga

SEQ ID NO: 1233 - DNA, 25 bp, Artificial sequence
  Synthetic oligonucleotide sequence
gaacctatgaactagctggactctg

SEQ ID NO: 1234 - DNA, 25 bp, Artificial sequence
  Synthetic oligonucleotide sequence
gaaacacgatccttatttgccagac

SEQ ID NO: 1235 - DNA, 25 bp, Artificial sequence
  Synthetic oligonucleotide sequence
gaaattcccatatgacacactgtga

SEQ ID NO: 1236 - DNA, 25 bp, Artificial sequence
  Synthetic oligonucleotide sequence
gacagcctgatcgtttgttggtgag

SEQ ID NO: 1237 - DNA, 25 bp, Artificial sequence
  Synthetic oligonucleotide sequence
gttgatagttttgcacctgaggacc

SEQ ID NO: 1238 - DNA, 25 bp, Artificial sequence
  Synthetic oligonucleotide sequence
tgagatggtgactttcctcttatcc

SEQ ID NO: 1239 - DNA, 25 bp, Artificial sequence
  Synthetic oligonucleotide sequence
tgatgatcccatcaggctgttcgga

SEQ ID NO: 1240 - DNA, 25 bp, Artificial sequence
  Synthetic oligonucleotide sequence
agcccattggctcttattaatcagt

SEQ ID NO: 1241 - DNA, 25 bp, Artificial sequence
  Synthetic oligonucleotide sequence
agaacggtgatctcttcttgaggaa

SEQ ID NO: 1242 - DNA, 25 bp, Artificial sequence
  Synthetic oligonucleotide sequence
aactatagctttgcctgtgaagaac

SEQ ID NO: 1243 - DNA, 25 bp, Artificial sequence
  Synthetic oligonucleotide sequence
tagccttagccgcaccaagggagaa

SEQ ID NO: 1244 - DNA, 25 bp, Artificial sequence
  Synthetic oligonucleotide sequence
ccattagtcttctgtaggtgttagc

SEQ ID NO: 1245 - DNA, 25 bp, Artificial sequence
  Synthetic oligonucleotide sequence
ccagggaatatcgagcccattggct

SEQ ID NO: 1246 - DNA, 25 bp, Artificial sequence
  Synthetic oligonucleotide sequence
taagctggtttcctaacattttcaa

SEQ ID NO: 1247 - DNA, 25 bp, Artificial sequence
  Synthetic oligonucleotide sequence
gtcagggatcctgtggagttcaaat

SEQ ID NO: 1248 - DNA, 25 bp, Artificial sequence
  Synthetic oligonucleotide sequence
gatcatttgctccactcagaggtag

SEQ ID NO: 1249 - DNA, 25 bp, Artificial sequence
  Synthetic oligonucleotide sequence
gtagatgttatcattctcccagaat

SEQ ID NO: 1250 - DNA, 25 bp, Artificial sequence
  Synthetic oligonucleotide sequence
ttttcaaccttgctcatactctgga

SEQ ID NO: 1251 - DNA, 25 bp, Artificial sequence
  Synthetic oligonucleotide sequence
agggacgatacttcttactgttgtt

SEQ ID NO: 1252 - DNA, 25 bp, Artificial sequence
  Synthetic oligonucleotide sequence
agcagtttatgtggttgattctcaa

SEQ ID NO: 1253 - DNA, 25 bp, Artificial sequence
  Synthetic oligonucleotide sequence
acgctggattgtagtctgtttactt

SEQ ID NO: 1254 - DNA, 25 bp, Artificial sequence
  Synthetic oligonucleotide sequence
aacagtggtctctttgacaaggcat

SEQ ID NO: 1255 - DNA, 25 bp, Artificial sequence
  Synthetic oligonucleotide sequence
cttcttactgttgttgacgctggat

SEQ ID NO: 1256 - DNA, 25 bp, Artificial sequence
  Synthetic oligonucleotide sequence
gcagggtgatgctgtctggtcttca

SEQ ID NO: 1257 - DNA, 25 bp, Artificial sequence
  Synthetic oligonucleotide sequence
gactgtatcttatccaccattgtat

SEQ ID NO: 1258 - DNA, 25 bp, Artificial sequence
  Synthetic oligonucleotide sequence
tttatcctaacagtggccctttgca

SEQ ID NO: 1259 - DNA, 25 bp, Artificial sequence
  Synthetic oligonucleotide sequence
tgtttacttgtctttctctttcgta

SEQ ID NO: 1260 - DNA, 25 bp, Artificial sequence
  Synthetic oligonucleotide sequence
tcttcagctcttcacacttacttaa

SEQ ID NO: 1261 - DNA, 25 bp, Artificial sequence
  Synthetic oligonucleotide sequence
ttaagacctggccttgactgaattt

SEQ ID NO: 1262 - DNA, 25 bp, Artificial sequence
  Synthetic oligonucleotide sequence
gaccgtaaaactatgttcaggcact

SEQ ID NO: 1263 - DNA, 25 bp, Artificial sequence
  Synthetic oligonucleotide sequence
aataccagcaagtcatgtcttgtgt

SEQ ID NO: 1264 - DNA, 25 bp, Artificial sequence
  Synthetic oligonucleotide sequence
aattgattgctgacttgacctgcct

SEQ ID NO: 1265 - DNA, 25 bp, Artificial sequence
  Synthetic oligonucleotide sequence
gacctgcctggtcaaatatctgaat

SEQ ID NO: 1266 - DNA, 25 bp, Artificial sequence
  Synthetic oligonucleotide sequence
gatggcattactgggtagattctaa

SEQ ID NO: 1267 - DNA, 25 bp, Artificial sequence
  Synthetic oligonucleotide sequence
gattctaacccatgattctaactgt

SEQ ID NO: 1268 - DNA, 25 bp, Artificial sequence
  Synthetic oligonucleotide sequence
gttacagttcaaattgtcccacttc

SEQ ID NO: 1269 - DNA, 25 bp, Artificial sequence
  Synthetic oligonucleotide sequence
gtattaccctctatcataacacact

SEQ ID NO: 1270 - DNA, 25 bp, Artificial sequence
  Synthetic oligonucleotide sequence
gtaactattgttgctattcatgtaa

SEQ ID NO: 1271 - DNA, 25 bp, Artificial sequence
  Synthetic oligonucleotide sequence
tactgtatcagctgtagttgggtga

SEQ ID NO: 1272 - DNA, 25 bp, Artificial sequence
  Synthetic oligonucleotide sequence
ttcaggcacttactcttcgtttata

SEQ ID NO: 1273 - DNA, 25 bp, Artificial sequence
  Synthetic oligonucleotide sequence
atgaacctctgtgtcctgtggaaaa

SEQ ID NO: 1274 - DNA, 25 bp, Artificial sequence
  Synthetic oligonucleotide sequence
atgagccaatgaacctctgtgtcct

SEQ ID NO: 1275 - DNA, 25 bp, Artificial sequence
  Synthetic oligonucleotide sequence
agtgaactatttgcaccttttgcta

SEQ ID NO: 1276 - DNA, 25 bp, Artificial sequence
  Synthetic oligonucleotide sequence
caccttttgctaatgcctctattta

SEQ ID NO: 1277 - DNA, 25 bp, Artificial sequence
  Synthetic oligonucleotide sequence
cagtgttttaatctcttagtggaaa

SEQ ID NO: 1278 - DNA, 25 bp, Artificial sequence
  Synthetic oligonucleotide sequence
ctggttctgtttggcgtatgtgtat

SEQ ID NO: 1279 - DNA, 25 bp, Artificial sequence
  Synthetic oligonucleotide sequence
gcctctatttacttgctttggcata

SEQ ID NO: 1280 - DNA, 25 bp, Artificial sequence
  Synthetic oligonucleotide sequence
gatctcactaactactggaatcagt

SEQ ID NO: 1281 - DNA, 25 bp, Artificial sequence
  Synthetic oligonucleotide sequence
gtaacctgtgaactatgcttttcca

SEQ ID NO: 1282 - DNA, 25 bp, Artificial sequence
  Synthetic oligonucleotide sequence
ggaaactctcagttgcttaattctg

SEQ ID NO: 1283 - DNA, 25 bp, Artificial sequence
  Synthetic oligonucleotide sequence
ggaaatttcattttagatctcacta

SEQ ID NO: 1284 - DNA, 25 bp, Artificial sequence
  Synthetic oligonucleotide sequence
atgtgtgtctctatgtacccaagcc

SEQ ID NO: 1285 - DNA, 25 bp, Artificial sequence
  Synthetic oligonucleotide sequence
agctctgcaagtcacttacctgaag

SEQ ID NO: 1286 - DNA, 25 bp, Artificial sequence
  Synthetic oligonucleotide sequence
agactcagggatgctgtttccagct

SEQ ID NO: 1287 - DNA, 25 bp, Artificial sequence
  Synthetic oligonucleotide sequence
agcgtgtgtctacatgtgtgtctct

SEQ ID NO: 1288 - DNA, 25 bp, Artificial sequence
  Synthetic oligonucleotide sequence
aagcacagtgtctctcgaatttcgg

SEQ ID NO: 1289 - DNA, 25 bp, Artificial sequence
  Synthetic oligonucleotide sequence
gagaggcgagcatctggctgtactt

SEQ ID NO: 1290 - DNA, 25 bp, Artificial sequence
  Synthetic oligonucleotide sequence
gtaccctcctcacatttttgcatat

SEQ ID NO: 1291 - DNA, 25 bp, Artificial sequence
  Synthetic oligonucleotide sequence
ggtggccacctgcatgagtgtatta

SEQ ID NO: 1292 - DNA, 25 bp, Artificial sequence
  Synthetic oligonucleotide sequence
ggatgcattctcttgttttgcttga

SEQ ID NO: 1293 - DNA, 25 bp, Artificial sequence
  Synthetic oligonucleotide sequence
tgagtcctgtgagatgcccttgtta

SEQ ID NO: 1294 - DNA, 25 bp, Artificial sequence
  Synthetic oligonucleotide sequence
tctggttctctctctcaggaataag

SEQ ID NO: 1295 - DNA, 25 bp, Artificial sequence
  Synthetic oligonucleotide sequence
agtaaagcaccccaattaaggcctg

SEQ ID NO: 1296 - DNA, 25 bp, Artificial sequence
  Synthetic oligonucleotide sequence
aaaatgctgcattttcttgctccca

SEQ ID NO: 1297 - DNA, 25 bp, Artificial sequence
  Synthetic oligonucleotide sequence
ccagcttcttgcgttttctgatgaa

SEQ ID NO: 1298 - DNA, 25 bp, Artificial sequence
  Synthetic oligonucleotide sequence
gacaaactcgtcttgaccgttgttt

SEQ ID NO: 1299 - DNA, 25 bp, Artificial sequence
  Synthetic oligonucleotide sequence
gttgttacaccagtgcgatggcttt

SEQ ID NO: 1300 - DNA, 25 bp, Artificial sequence
  Synthetic oligonucleotide sequence
ggcacaaagatctcactgttaccca

SEQ ID NO: 1301 - DNA, 25 bp, Artificial sequence
  Synthetic oligonucleotide sequence
tagggcagcactccaatttcaaact

SEQ ID NO: 1302 - DNA, 25 bp, Artificial sequence
  Synthetic oligonucleotide sequence
ttttgttctcctttatcctacctga

SEQ ID NO: 1303 - DNA, 25 bp, Artificial sequence
  Synthetic oligonucleotide sequence
ttcaaactgttagccacctggtgat

SEQ ID NO: 1304 - DNA, 25 bp, Artificial sequence
  Synthetic oligonucleotide sequence
ttgtttctaaccctttgttccacag

SEQ ID NO: 1305 - DNA, 25 bp, Artificial sequence
  Synthetic oligonucleotide sequence
ttgctcccacaaagctggtatgctg

SEQ ID NO: 1306 - DNA, 25 bp, Artificial sequence
  Synthetic oligonucleotide sequence
agtgaacttgtccttgccagatggg

SEQ ID NO: 1307 - DNA, 25 bp, Artificial sequence
  Synthetic oligonucleotide sequence
actcagcagtgagttgcctgtggct

SEQ ID NO: 1308 - DNA, 25 bp, Artificial sequence
  Synthetic oligonucleotide sequence
aaataagtgcattctcctcagagga

SEQ ID NO: 1309 - DNA, 25 bp, Artificial sequence
  Synthetic oligonucleotide sequence
ctccatgccttcaactcaacaaatg

SEQ ID NO: 1310 - DNA, 25 bp, Artificial sequence
  Synthetic oligonucleotide sequence
gctggaaacaagctgtgccttcaaa

SEQ ID NO: 1311 - DNA, 25 bp, Artificial sequence
  Synthetic oligonucleotide sequence
gcctatgtaggccttttctgcagaa

SEQ ID NO: 1312 - DNA, 25 bp, Artificial sequence
  Synthetic oligonucleotide sequence
gtctttaagcatcttcagctctgat

SEQ ID NO: 1313 - DNA, 25 bp, Artificial sequence
  Synthetic oligonucleotide sequence
gggctttttgttcagtctgtatcag

SEQ ID NO: 1314 - DNA, 25 bp, Artificial sequence
  Synthetic oligonucleotide sequence
ggaaactatttctaacatctggtga

SEQ ID NO: 1315 - DNA, 25 bp, Artificial sequence
  Synthetic oligonucleotide sequence
tggctgtcttttcttgtattctgta

SEQ ID NO: 1316 - DNA, 25 bp, Artificial sequence
  Synthetic oligonucleotide sequence
tcagaacagcgtttgtgctccatgc

SEQ ID NO: 1317 - DNA, 25 bp, Artificial sequence
  Synthetic oligonucleotide sequence
attttgttcattgtcggttgggcca

SEQ ID NO: 1318 - DNA, 25 bp, Artificial sequence
  Synthetic oligonucleotide sequence
attttctcaatcatacacgtcgtta

SEQ ID NO: 1319 - DNA, 25 bp, Artificial sequence
  Synthetic oligonucleotide sequence
aggcaggtcacctaatctgtctcag

SEQ ID NO: 1320 - DNA, 25 bp, Artificial sequence
  Synthetic oligonucleotide sequence
aggactgagctcctgaagctgctga

SEQ ID NO: 1321 - DNA, 25 bp, Artificial sequence
  Synthetic oligonucleotide sequence
ccagtctcccagcttaaaacgtgat

SEQ ID NO: 1322 - DNA, 25 bp, Artificial sequence
  Synthetic oligonucleotide sequence
aaatggctctggcacacctgtgata

SEQ ID NO: 1323 - DNA, 25 bp, Artificial sequence
  Synthetic oligonucleotide sequence
gaagctgctgatgtccctgtcagga

SEQ ID NO: 1324 - DNA, 25 bp, Artificial sequence
  Synthetic oligonucleotide sequence
gaagatgttctccaaagcactttga

SEQ ID NO: 1325 - DNA, 25 bp, Artificial sequence
  Synthetic oligonucleotide sequence
gaagcaaagcattggcctgctccac

SEQ ID NO: 1326 - DNA, 25 bp, Artificial sequence
  Synthetic oligonucleotide sequence
gtgtctgtcgttgtgtttccagaga

SEQ ID NO: 1327 - DNA, 25 bp, Artificial sequence
  Synthetic oligonucleotide sequence
tgtcaggactttacggagcccacta

SEQ ID NO: 1328 - DNA, 25 bp, Artificial sequence
  Synthetic oligonucleotide sequence
atcgtgtcagcacagaaaccttctc

SEQ ID NO: 1329 - DNA, 25 bp, Artificial sequence
  Synthetic oligonucleotide sequence
agagaattagtcactgggccaggcg

SEQ ID NO: 1330 - DNA, 25 bp, Artificial sequence
  Synthetic oligonucleotide sequence
acaattcagaagtgtccagcccagc

SEQ ID NO: 1331 - DNA, 25 bp, Artificial sequence
  Synthetic oligonucleotide sequence
aaccttctcaggtacaggctttgtt

SEQ ID NO: 1332 - DNA, 25 bp, Artificial sequence
  Synthetic oligonucleotide sequence
gcttcccacggaactgagcagagaa

SEQ ID NO: 1333 - DNA, 25 bp, Artificial sequence
  Synthetic oligonucleotide sequence
gaagggcagcccactggcatcgtgt

SEQ ID NO: 1334 - DNA, 25 bp, Artificial sequence
  Synthetic oligonucleotide sequence
ggtgtgaaagactcctgctattata

SEQ ID NO: 1335 - DNA, 25 bp, Artificial sequence
  Synthetic oligonucleotide sequence
tgtgtcggttaccactcaagacgca

SEQ ID NO: 1336 - DNA, 25 bp, Artificial sequence
  Synthetic oligonucleotide sequence
tccagtgtggtggttagtctgcctt

SEQ ID NO: 1337 - DNA, 25 bp, Artificial sequence
  Synthetic oligonucleotide sequence
tattataagcactcagtccgcttcc

SEQ ID NO: 1338 - DNA, 25 bp, Artificial sequence
  Synthetic oligonucleotide sequence
ttgcggttctggactttgtttttat

SEQ ID NO: 1339 - DNA, 25 bp, Artificial sequence
  Synthetic oligonucleotide sequence
agttccagtcgcagatcagctccaa

SEQ ID NO: 1340 - DNA, 25 bp, Artificial sequence
  Synthetic oligonucleotide sequence
agatgtttgctccatacgggaccat

SEQ ID NO: 1341 - DNA, 25 bp, Artificial sequence
  Synthetic oligonucleotide sequence
agagcccgctgatgagcgagttcca

SEQ ID NO: 1342 - DNA, 25 bp, Artificial sequence
  Synthetic oligonucleotide sequence
agacagtttggctttcttccattgt

SEQ ID NO: 1343 - DNA, 25 bp, Artificial sequence
  Synthetic oligonucleotide sequence
aactgaagcgatcggccatgagagc

SEQ ID NO: 1344 - DNA, 25 bp, Artificial sequence
  Synthetic oligonucleotide sequence
gaaagactcatcgtccactaacttg

SEQ ID NO: 1345 - DNA, 25 bp, Artificial sequence
  Synthetic oligonucleotide sequence
gggaccattacgttgaccatacgat

SEQ ID NO: 1346 - DNA, 25 bp, Artificial sequence
  Synthetic oligonucleotide sequence
gtgtatttccataatccagaggttg

SEQ ID NO: 1347 - DNA, 25 bp, Artificial sequence
  Synthetic oligonucleotide sequence
ggtccagtatctatttgccctgtaa

SEQ ID NO: 1348 - DNA, 25 bp, Artificial sequence
  Synthetic oligonucleotide sequence
ggcagccatctttgagagcatccag

SEQ ID NO: 1349 - DNA, 25 bp, Artificial sequence
  Synthetic oligonucleotide sequence
tgaccattcccgaggccgagaagag

SEQ ID NO: 1350 - DNA, 25 bp, Artificial sequence
  Synthetic oligonucleotide sequence
atcttggcaccttgctcttttagaa

SEQ ID NO: 1351 - DNA, 25 bp, Artificial sequence
  Synthetic oligonucleotide sequence
aaaatacattgctcacctttcctgt

SEQ ID NO: 1352 - DNA, 25 bp, Artificial sequence
  Synthetic oligonucleotide sequence
aactctagaactctcagacgctgcg

SEQ ID NO: 1353 - DNA, 25 bp, Artificial sequence
  Synthetic oligonucleotide sequence
gattctcagggaaactccgactgga

SEQ ID NO: 1354 - DNA, 25 bp, Artificial sequence
  Synthetic oligonucleotide sequence
gctagatttcaaaggctcgcttcgc

SEQ ID NO: 1355 - DNA, 25 bp, Artificial sequence
  Synthetic oligonucleotide sequence
ctggatttatttttctacctgtgta

SEQ ID NO: 1356 - DNA, 25 bp, Artificial sequence
  Synthetic oligonucleotide sequence
gctggtgctctatagttttgttctc

SEQ ID NO: 1357 - DNA, 25 bp, Artificial sequence
  Synthetic oligonucleotide sequence
gtaaaatcctgtcagaccaccgata

SEQ ID NO: 1358 - DNA, 25 bp, Artificial sequence
  Synthetic oligonucleotide sequence
gtacatctagttcctcaccatagaa

SEQ ID NO: 1359 - DNA, 25 bp, Artificial sequence
  Synthetic oligonucleotide sequence
tcgcttcgcaaaaatactccatctt

SEQ ID NO: 1360 - DNA, 25 bp, Artificial sequence
  Synthetic oligonucleotide sequence
ttcagcccctgaagcttgctaatat

SEQ ID NO: 1361 - DNA, 25 bp, Artificial sequence
  Synthetic oligonucleotide sequence
atttttgctgccatacactaactca

SEQ ID NO: 1362 - DNA, 25 bp, Artificial sequence
  Synthetic oligonucleotide sequence
attttgcctgcactcttcattctta

SEQ ID NO: 1363 - DNA, 25 bp, Artificial sequence
  Synthetic oligonucleotide sequence
gaaacttatggaatgtgaccctgat

SEQ ID NO: 1364 - DNA, 25 bp, Artificial sequence
  Synthetic oligonucleotide sequence
gaggatgccacagaggtttgcaaga

SEQ ID NO: 1365 - DNA, 25 bp, Artificial sequence
  Synthetic oligonucleotide sequence
gatgtgtggcaaatactcaatgtta

SEQ ID NO: 1366 - DNA, 25 bp, Artificial sequence
  Synthetic oligonucleotide sequence
gtgttattgcattagctcccttcga

SEQ ID NO: 1367 - DNA, 25 bp, Artificial sequence
  Synthetic oligonucleotide sequence
ggagctacttcacaattttgcctgc

SEQ ID NO: 1368 - DNA, 25 bp, Artificial sequence
  Synthetic oligonucleotide sequence
tggaagcaccaaatactgtcttatt

SEQ ID NO: 1369 - DNA, 25 bp, Artificial sequence
  Synthetic oligonucleotide sequence
ttcgatgggcatctctatgaattag

SEQ ID NO: 1370 - DNA, 25 bp, Artificial sequence
  Synthetic oligonucleotide sequence
taaccccttgcaccatgactgatgt

SEQ ID NO: 1371 - DNA, 25 bp, Artificial sequence
  Synthetic oligonucleotide sequence
ttgtgatcactctttctgacgcata

SEQ ID NO: 1372 - DNA, 25 bp, Artificial sequence
  Synthetic oligonucleotide sequence
atactgggctctgaatggctatgac

SEQ ID NO: 1373 - DNA, 25 bp, Artificial sequence
  Synthetic oligonucleotide sequence
atgacattcagcaaggttatcccaa

SEQ ID NO: 1374 - DNA, 25 bp, Artificial sequence
  Synthetic oligonucleotide sequence
agatgacttctttcttttcttcagc

SEQ ID NO: 1375 - DNA, 25 bp, Artificial sequence
  Synthetic oligonucleotide sequence
agcatagcaagtacctttccaggaa

SEQ ID NO: 1376 - DNA, 25 bp, Artificial sequence
  Synthetic oligonucleotide sequence
aatttcatttctctgttctggccat

SEQ ID NO: 1377 - DNA, 25 bp, Artificial sequence
  Synthetic oligonucleotide sequence
cttcccaagcagtgtccaagcaatt

SEQ ID NO: 1378 - DNA, 25 bp, Artificial sequence
  Synthetic oligonucleotide sequence
tcagcggaccagtttattatgcatt

SEQ ID NO: 1379 - DNA, 25 bp, Artificial sequence
  Synthetic oligonucleotide sequence
gaagcaggttatccccaaagcatag

SEQ ID NO: 1380 - DNA, 25 bp, Artificial sequence
  Synthetic oligonucleotide sequence
gacatatcaaactacggcttcccaa

SEQ ID NO: 1381 - DNA, 25 bp, Artificial sequence
  Synthetic oligonucleotide sequence
tgatgcagctgtttcctataggagt

SEQ ID NO: 1382 - DNA, 25 bp, Artificial sequence
  Synthetic oligonucleotide sequence
tttctctcctgtgttccattaggta

SEQ ID NO: 1383 - DNA, 25 bp, Artificial sequence
  Synthetic oligonucleotide sequence
atgtatcgcttccagaccaggccag

SEQ ID NO: 1384 - DNA, 25 bp, Artificial sequence
  Synthetic oligonucleotide sequence
aggcaaataagtccctctggtccta

SEQ ID NO: 1385 - DNA, 25 bp, Artificial sequence
  Synthetic oligonucleotide sequence
agggcaagcttctcgcatgtatcgc

SEQ ID NO: 1386 - DNA, 25 bp, Artificial sequence
  Synthetic oligonucleotide sequence
aaaatcagcagtctcctggaggagc

SEQ ID NO: 1387 - DNA, 25 bp, Artificial sequence
  Synthetic oligonucleotide sequence
aagaccctggtgaagaactgcatcg

SEQ ID NO: 1388 - DNA, 25 bp, Artificial sequence
  Synthetic oligonucleotide sequence
cagacggctatgtgctcgagggcaa

SEQ ID NO: 1389 - DNA, 25 bp, Artificial sequence
  Synthetic oligonucleotide sequence
gaaagccctaccacaagaagcggaa

SEQ ID NO: 1390 - DNA, 25 bp, Artificial sequence
  Synthetic oligonucleotide sequence
gaactgcatcgtgctggttgacagc

SEQ ID NO: 1391 - DNA, 25 bp, Artificial sequence
  Synthetic oligonucleotide sequence
ggcaaggagctggagttctatctga

SEQ ID NO: 1392 - DNA, 25 bp, Artificial sequence
  Synthetic oligonucleotide sequence
ggagcagttccagcagggcaagctt

SEQ ID NO: 1393 - DNA, 25 bp, Artificial sequence
  Synthetic oligonucleotide sequence
ggctccgagtgctgtacgcgcaaaa

SEQ ID NO: 1394 - DNA, 25 bp, Artificial sequence
  Synthetic oligonucleotide sequence
gtggtaagacctcaaactgcaagtg

SEQ ID NO: 1395 - DNA, 25 bp, Artificial sequence
  Synthetic oligonucleotide sequence
acaagcctttgccttgactgaggag

SEQ ID NO: 1396 - DNA, 25 bp, Artificial sequence
  Synthetic oligonucleotide sequence
aaatctttcttttcttgtggatgac

SEQ ID NO: 1397 - DNA, 25 bp, Artificial sequence
  Synthetic oligonucleotide sequence
aagccctttattttacaactctgtg

SEQ ID NO: 1398 - DNA, 25 bp, Artificial sequence
  Synthetic oligonucleotide sequence
aactctgtggagcttcattattaac

SEQ ID NO: 1399 - DNA, 25 bp, Artificial sequence
  Synthetic oligonucleotide sequence
gatggtttgatttctctttgtcagg

SEQ ID NO: 1400 - DNA, 25 bp, Artificial sequence
  Synthetic oligonucleotide sequence
gtacgtgtcacatgttctcgtgtcg

SEQ ID NO: 1401 - DNA, 25 bp, Artificial sequence
  Synthetic oligonucleotide sequence
gtgactattgcagagcctttggata

SEQ ID NO: 1402 - DNA, 25 bp, Artificial sequence
  Synthetic oligonucleotide sequence
tcgtgtcgggtttcaggctctgcaa

SEQ ID NO: 1403 - DNA, 25 bp, Artificial sequence
  Synthetic oligonucleotide sequence
tcatgctctgtacttgacctcaaaa

SEQ ID NO: 1404 - DNA, 25 bp, Artificial sequence
  Synthetic oligonucleotide sequence
tatagattctcatcactgtggcgaa

SEQ ID NO: 1405 - DNA, 25 bp, Artificial sequence
  Synthetic oligonucleotide sequence
attcaggaagtattccgccagccat

SEQ ID NO: 1406 - DNA, 25 bp, Artificial sequence
  Synthetic oligonucleotide sequence
atcacagtcttcttccgaatctgat

SEQ ID NO: 1407 - DNA, 25 bp, Artificial sequence
  Synthetic oligonucleotide sequence
aaagatgccatacatttgcctttgg

SEQ ID NO: 1408 - DNA, 25 bp, Artificial sequence
  Synthetic oligonucleotide sequence
gaggcatagctccacgttaggactg

SEQ ID NO: 1409 - DNA, 25 bp, Artificial sequence
  Synthetic oligonucleotide sequence
gagtaattagccctcgtctttggac

SEQ ID NO: 1410 - DNA, 25 bp, Artificial sequence
  Synthetic oligonucleotide sequence
gagatagcggcagtcagtcatttga

SEQ ID NO: 1411 - DNA, 25 bp, Artificial sequence
  Synthetic oligonucleotide sequence
gtccacatttgggttcattcctaag

SEQ ID NO: 1412 - DNA, 25 bp, Artificial sequence
  Synthetic oligonucleotide sequence
ggacttacccagttatacggagcac

SEQ ID NO: 1413 - DNA, 25 bp, Artificial sequence
  Synthetic oligonucleotide sequence
tggtcacggaaacatgcccagatga

SEQ ID NO: 1414 - DNA, 25 bp, Artificial sequence
  Synthetic oligonucleotide sequence
tgccgcattggctcatattcaggaa

SEQ ID NO: 1415 - DNA, 25 bp, Artificial sequence
  Synthetic oligonucleotide sequence
tttgaggtcctagcgatcaggcatc

SEQ ID NO: 1416 - DNA, 25 bp, Artificial sequence
  Synthetic oligonucleotide sequence
ctcctgaacacttacgtcttagcaa

SEQ ID NO: 1417 - DNA, 25 bp, Artificial sequence
  Synthetic oligonucleotide sequence
acacctgtgtttaatctgattcatg

SEQ ID NO: 1418 - DNA, 25 bp, Artificial sequence
  Synthetic oligonucleotide sequence
aactttgttaacatccgtctcttgc

SEQ ID NO: 1419 - DNA, 25 bp, Artificial sequence
  Synthetic oligonucleotide sequence
aatcatgttatctttgggcagtcgt

SEQ ID NO: 1420 - DNA, 25 bp, Artificial sequence
  Synthetic oligonucleotide sequence
cgtctcttgcacatctacaacaaat

SEQ ID NO: 1421 - DNA, 25 bp, Artificial sequence
  Synthetic oligonucleotide sequence
gcattcgagaatcaagtcagccaga

SEQ ID NO: 1422 - DNA, 25 bp, Artificial sequence
  Synthetic oligonucleotide sequence
gaccatgtatactctcttgcttgaa

SEQ ID NO: 1423 - DNA, 25 bp, Artificial sequence
  Synthetic oligonucleotide sequence
tggagagacctgttcacacctgtgt

SEQ ID NO: 1424 - DNA, 25 bp, Artificial sequence
  Synthetic oligonucleotide sequence
tgggcagtcgttgcattcgagaatc

SEQ ID NO: 1425 - DNA, 25 bp, Artificial sequence
  Synthetic oligonucleotide sequence
tgaatatccactgtttaccaccatg

SEQ ID NO: 1426 - DNA, 25 bp, Artificial sequence
  Synthetic oligonucleotide sequence
ttttcttggcttttcctcctgaaca

SEQ ID NO: 1427 - DNA, 25 bp, Artificial sequence
  Synthetic oligonucleotide sequence
attaccgtcattggcctgtgaagca

SEQ ID NO: 1428 - DNA, 25 bp, Artificial sequence
  Synthetic oligonucleotide sequence
agtgcaatactgagtgtgcctcatt

SEQ ID NO: 1429 - DNA, 25 bp, Artificial sequence
  Synthetic oligonucleotide sequence
aatcctgtacaattgcatcacgggt

SEQ ID NO: 1430 - DNA, 25 bp, Artificial sequence
  Synthetic oligonucleotide sequence
cgggaccattttgacatccatgaaa

SEQ ID NO: 1431 - DNA, 25 bp, Artificial sequence
  Synthetic oligonucleotide sequence
gaatattctggtttatttcctagac

SEQ ID NO: 1432 - DNA, 25 bp, Artificial sequence
  Synthetic oligonucleotide sequence
gaaggatgccaaataccatgtacat

SEQ ID NO: 1433 - DNA, 25 bp, Artificial sequence
  Synthetic oligonucleotide sequence
gaatgatgctggctttcaagcaaaa

SEQ ID NO: 1434 - DNA, 25 bp, Artificial sequence
  Synthetic oligonucleotide sequence
gtatactacctttttgtaatcctgt

SEQ ID NO: 1435 - DNA, 25 bp, Artificial sequence
  Synthetic oligonucleotide sequence
gtgcctcattatcttgcagctgtaa

SEQ ID NO: 1436 - DNA, 25 bp, Artificial sequence
  Synthetic oligonucleotide sequence
gtgtttgcatgtggccattaccgtc

SEQ ID NO: 1437 - DNA, 25 bp, Artificial sequence
  Synthetic oligonucleotide sequence
tccccattatttcggtttatcttct

SEQ ID NO: 1438 - DNA, 25 bp, Artificial sequence
  Synthetic oligonucleotide sequence
ataaatgagcagaccctgcctttgg

SEQ ID NO: 1439 - DNA, 25 bp, Artificial sequence
  Synthetic oligonucleotide sequence
agatgcctgttgttttattgtgtat

SEQ ID NO: 1440 - DNA, 25 bp, Artificial sequence
  Synthetic oligonucleotide sequence
agaaactcatgcatctgtggtccat

SEQ ID NO: 1441 - DNA, 25 bp, Artificial sequence
  Synthetic oligonucleotide sequence
caccgctatctgcatgattctgaac

SEQ ID NO: 1442 - DNA, 25 bp, Artificial sequence
  Synthetic oligonucleotide sequence
ctgcctttggattgggtgctgataa

SEQ ID NO: 1443 - DNA, 25 bp, Artificial sequence
  Synthetic oligonucleotide sequence
gaagtctgctcaaagtaacctgtca

SEQ ID NO: 1444 - DNA, 25 bp, Artificial sequence
  Synthetic oligonucleotide sequence
gattaatctcctcttggtgttttga

SEQ ID NO: 1445 - DNA, 25 bp, Artificial sequence
  Synthetic oligonucleotide sequence
gtttcccctcagtgtcttatattaa

SEQ ID NO: 1446 - DNA, 25 bp, Artificial sequence
  Synthetic oligonucleotide sequence
gggtgctgataacgactattttcta

SEQ ID NO: 1447 - DNA, 25 bp, Artificial sequence
  Synthetic oligonucleotide sequence
ggtccatgggttatatcctggctca

SEQ ID NO: 1448 - DNA, 25 bp, Artificial sequence
  Synthetic oligonucleotide sequence
tattatttttggtttcccctcagtg

SEQ ID NO: 1449 - DNA, 25 bp, Artificial sequence
  Synthetic oligonucleotide sequence
cgtgggacgtttttgcatttggact

SEQ ID NO: 1450 - DNA, 25 bp, Artificial sequence
  Synthetic oligonucleotide sequence
gctaaacccgtatgcgaagaccatg

SEQ ID NO: 1451 - DNA, 25 bp, Artificial sequence
  Synthetic oligonucleotide sequence
aggccaagaatcacaaactccgggt

SEQ ID NO: 1452 - DNA, 25 bp, Artificial sequence
  Synthetic oligonucleotide sequence
agatgatctttatggcacttggcgt

SEQ ID NO: 1453 - DNA, 25 bp, Artificial sequence
  Synthetic oligonucleotide sequence
agcctgctgcgtaaacttgtttgtt

SEQ ID NO: 1454 - DNA, 25 bp, Artificial sequence
  Synthetic oligonucleotide sequence
aagagtaactacaaccttcccatgc

SEQ ID NO: 1455 - DNA, 25 bp, Artificial sequence
  Synthetic oligonucleotide sequence
aagcgctttccgcaagttagatgat

SEQ ID NO: 1456 - DNA, 25 bp, Artificial sequence
  Synthetic oligonucleotide sequence
gaagaccatgcgcaggaacaccatt

SEQ ID NO: 1457 - DNA, 25 bp, Artificial sequence
  Synthetic oligonucleotide sequence
gaagattcatcgcagggtcctgaag

SEQ ID NO: 1458 - DNA, 25 bp, Artificial sequence
  Synthetic oligonucleotide sequence
gtaaagctgcttccctcaagagtaa

SEQ ID NO: 1459 - DNA, 25 bp, Artificial sequence
  Synthetic oligonucleotide sequence
ggtcacatcattttggacagctcct

SEQ ID NO: 1460 - DNA, 25 bp, Artificial sequence
  Synthetic oligonucleotide sequence
ataggacaaacttctgactcccttc

SEQ ID NO: 1461 - DNA, 25 bp, Artificial sequence
  Synthetic oligonucleotide sequence
aaccgtgctactttggcatggtcat

SEQ ID NO: 1462 - DNA, 25 bp, Artificial sequence
  Synthetic oligonucleotide sequence
aaatgtaactactgctgcctttctg

SEQ ID NO: 1463 - DNA, 25 bp, Artificial sequence
  Synthetic oligonucleotide sequence
aaatgttcagcagcccagagcagtt

SEQ ID NO: 1464 - DNA, 25 bp, Artificial sequence
  Synthetic oligonucleotide sequence
gaaacccaccatgcagttctgtatt

SEQ ID NO: 1465 - DNA, 25 bp, Artificial sequence
  Synthetic oligonucleotide sequence
gactcccttctttcatttttagatt

SEQ ID NO: 1466 - DNA, 25 bp, Artificial sequence
  Synthetic oligonucleotide sequence
gttactggtatcactttctgagaaa

SEQ ID NO: 1467 - DNA, 25 bp, Artificial sequence
  Synthetic oligonucleotide sequence
ggtaatttgttccatgtcctgactc

SEQ ID NO: 1468 - DNA, 25 bp, Artificial sequence
  Synthetic oligonucleotide sequence
ggcagtgacacttaacctgattttt

SEQ ID NO: 1469 - DNA, 25 bp, Artificial sequence
  Synthetic oligonucleotide sequence
taatttgggcattctactcttagca

SEQ ID NO: 1470 - DNA, 25 bp, Artificial sequence
  Synthetic oligonucleotide sequence
taaactgtcgccttaactatgctaa

SEQ ID NO: 1471 - DNA, 25 bp, Artificial sequence
  Synthetic oligonucleotide sequence
aaatggagattggaccccgatcttc

SEQ ID NO: 1472 - DNA, 25 bp, Artificial sequence
  Synthetic oligonucleotide sequence
cctctggtcattgagcctttggata

SEQ ID NO: 1473 - DNA, 25 bp, Artificial sequence
  Synthetic oligonucleotide sequence
gtattttagttctcagttctcacca

SEQ ID NO: 1474 - DNA, 25 bp, Artificial sequence
  Synthetic oligonucleotide sequence
gaacaggtgactttcctctaactgt

SEQ ID NO: 1475 - DNA, 25 bp, Artificial sequence
  Synthetic oligonucleotide sequence
gatcttccctttcttgtatgttgct

SEQ ID NO: 1476 - DNA, 25 bp, Artificial sequence
  Synthetic oligonucleotide sequence
gtgtgagctcaggacatgtggcctc

SEQ ID NO: 1477 - DNA, 25 bp, Artificial sequence
  Synthetic oligonucleotide sequence
ggtcatctactttcccagtattttt

SEQ ID NO: 1478 - DNA, 25 bp, Artificial sequence
  Synthetic oligonucleotide sequence
ttttcccgtttctcagtgaccagat

SEQ ID NO: 1479 - DNA, 25 bp, Artificial sequence
  Synthetic oligonucleotide sequence
tgcttacacatttcaggccctttag

SEQ ID NO: 1480 - DNA, 25 bp, Artificial sequence
  Synthetic oligonucleotide sequence
tttacacttgctacaggtcacggac

SEQ ID NO: 1481 - DNA, 25 bp, Artificial sequence
  Synthetic oligonucleotide sequence
ttctggctcctcaaaagcagtgggt

SEQ ID NO: 1482 - DNA, 25 bp, Artificial sequence
  Synthetic oligonucleotide sequence
agataccgtgtcttcagactgtctc

SEQ ID NO: 1483 - DNA, 25 bp, Artificial sequence
  Synthetic oligonucleotide sequence
aaccctagcagcgttgcctgagata

SEQ ID NO: 1484 - DNA, 25 bp, Artificial sequence
  Synthetic oligonucleotide sequence
gaggccctacggtgaaagttgcaat

SEQ ID NO: 1485 - DNA, 25 bp, Artificial sequence
  Synthetic oligonucleotide sequence
gctgaatattactacaccgtgtgct

SEQ ID NO: 1486 - DNA, 25 bp, Artificial sequence
  Synthetic oligonucleotide sequence
gtattcgtaaaagtcagcccctcgg

SEQ ID NO: 1487 - DNA, 25 bp, Artificial sequence
  Synthetic oligonucleotide sequence
gtaggctgttaccatttctgcgttt

SEQ ID NO: 1488 - DNA, 25 bp, Artificial sequence
  Synthetic oligonucleotide sequence
tgagatttttctgaggtgtcccctt

SEQ ID NO: 1489 - DNA, 25 bp, Artificial sequence
  Synthetic oligonucleotide sequence
tccccttttgttgataccttcgata

SEQ ID NO: 1490 - DNA, 25 bp, Artificial sequence
  Synthetic oligonucleotide sequence
tctgaccatctaccggaagtgcgta

SEQ ID NO: 1491 - DNA, 25 bp, Artificial sequence
  Synthetic oligonucleotide sequence
taaaaacgagcttgcgactctgccg

SEQ ID NO: 1492 - DNA, 25 bp, Artificial sequence
  Synthetic oligonucleotide sequence
tacttgctctgaaccttgctgagtt

SEQ ID NO: 1493 - DNA, 25 bp, Artificial sequence
  Synthetic oligonucleotide sequence
atacgagtcagcttctgtagcataa

SEQ ID NO: 1494 - DNA, 25 bp, Artificial sequence
  Synthetic oligonucleotide sequence
agtgtacaagcgtcatttatagttt

SEQ ID NO: 1495 - DNA, 25 bp, Artificial sequence
  Synthetic oligonucleotide sequence
agtggcctcacttcaagcagtttgc

SEQ ID NO: 1496 - DNA, 25 bp, Artificial sequence
  Synthetic oligonucleotide sequence
agcagtttgcctttgttctttaaat

SEQ ID NO: 1497 - DNA, 25 bp, Artificial sequence
  Synthetic oligonucleotide sequence
aacttttgcttactgtgctcacatc

SEQ ID NO: 1498 - DNA, 25 bp, Artificial sequence
  Synthetic oligonucleotide sequence
aattcttccacttgttttacatcac

SEQ ID NO: 1499 - DNA, 25 bp, Artificial sequence
  Synthetic oligonucleotide sequence
gtattatgcttttctgttgagggag

SEQ ID NO: 1500 - DNA, 25 bp, Artificial sequence
  Synthetic oligonucleotide sequence
gtggtttgtcactgtaatacgagtc

SEQ ID NO: 1501 - DNA, 25 bp, Artificial sequence
  Synthetic oligonucleotide sequence
ttatttgggttaaagtggcctcact

SEQ ID NO: 1502 - DNA, 25 bp, Artificial sequence
  Synthetic oligonucleotide sequence
ggtttgatttcctataattcttcca

SEQ ID NO: 1503 - DNA, 25 bp, Artificial sequence
  Synthetic oligonucleotide sequence
ggctttgaggatttttctggcatta

SEQ ID NO: 1504 - DNA, 25 bp, Artificial sequence
  Synthetic oligonucleotide sequence
ttttcccataactgagcctacgtga

SEQ ID NO: 1505 - DNA, 25 bp, Artificial sequence
  Synthetic oligonucleotide sequence
aaaatgtgtcactcgctttcttctg

SEQ ID NO: 1506 - DNA, 25 bp, Artificial sequence
  Synthetic oligonucleotide sequence
cagcgtgaacgtaccataattttaa

SEQ ID NO: 1507 - DNA, 25 bp, Artificial sequence
  Synthetic oligonucleotide sequence
gctcatgtcttcatttgcttatcca

SEQ ID NO: 1508 - DNA, 25 bp, Artificial sequence
  Synthetic oligonucleotide sequence
ttttctttcagggagtttgccccag

SEQ ID NO: 1509 - DNA, 25 bp, Artificial sequence
  Synthetic oligonucleotide sequence
gcaactctctagtgtcagcgtgtag

SEQ ID NO: 1510 - DNA, 25 bp, Artificial sequence
  Synthetic oligonucleotide sequence
gttgtcccttcggtggtgtatgaaa

SEQ ID NO: 1511 - DNA, 25 bp, Artificial sequence
  Synthetic oligonucleotide sequence
tgtagagcccaatacttcccagtat

SEQ ID NO: 1512 - DNA, 25 bp, Artificial sequence
  Synthetic oligonucleotide sequence
tatgcattcctttggttacttgtga

SEQ ID NO: 1513 - DNA, 25 bp, Artificial sequence
  Synthetic oligonucleotide sequence
tagtctcttgtttcattatgcattc

SEQ ID NO: 1514 - DNA, 25 bp, Artificial sequence
  Synthetic oligonucleotide sequence
ttggcagattgcttcagagacatgt

SEQ ID NO: 1515 - DNA, 25 bp, Artificial sequence
  Synthetic oligonucleotide sequence
ataacctaacttatgccccattttg

SEQ ID NO: 1516 - DNA, 25 bp, Artificial sequence
  Synthetic oligonucleotide sequence
atggctatgtaacccacgagtgcta

SEQ ID NO: 1517 - DNA, 25 bp, Artificial sequence
  Synthetic oligonucleotide sequence
acgagtgctatctaggtgaccttcc

SEQ ID NO: 1518 - DNA, 25 bp, Artificial sequence
  Synthetic oligonucleotide sequence
acaatctcagtcctttttcttacag

SEQ ID NO: 1519 - DNA, 25 bp, Artificial sequence
  Synthetic oligonucleotide sequence
aacagtatgtcttcctgggagggca

SEQ ID NO: 1520 - DNA, 25 bp, Artificial sequence
  Synthetic oligonucleotide sequence
aagtgaagtgtctagttgctgccct

SEQ ID NO: 1521 - DNA, 25 bp, Artificial sequence
  Synthetic oligonucleotide sequence
cagatggtactgcttgtgctctcaa

SEQ ID NO: 1522 - DNA, 25 bp, Artificial sequence
  Synthetic oligonucleotide sequence
gcagactctgctatgttttctttgt

SEQ ID NO: 1523 - DNA, 25 bp, Artificial sequence
  Synthetic oligonucleotide sequence
gacacatttcatatcccacttgtag

SEQ ID NO: 1524 - DNA, 25 bp, Artificial sequence
  Synthetic oligonucleotide sequence
gttgctgccctttttactgagttaa

SEQ ID NO: 1525 - DNA, 25 bp, Artificial sequence
  Synthetic oligonucleotide sequence
tgagtcctagttgccataccaggtt

SEQ ID NO: 1526 - DNA, 25 bp, Artificial sequence
  Synthetic oligonucleotide sequence
gaaaatgctttcctgaacctggtcc

SEQ ID NO: 1527 - DNA, 25 bp, Artificial sequence
  Synthetic oligonucleotide sequence
gaacaagcccctgtattttgctgac

SEQ ID NO: 1528 - DNA, 25 bp, Artificial sequence
  Synthetic oligonucleotide sequence
gagctacagcccttatgacatgttg

SEQ ID NO: 1529 - DNA, 25 bp, Artificial sequence
  Synthetic oligonucleotide sequence
gaggatgatgttagccttgtgcccc

SEQ ID NO: 1530 - DNA, 25 bp, Artificial sequence
  Synthetic oligonucleotide sequence
ggcacgcgcgataaggtcctgatca

SEQ ID NO: 1531 - DNA, 25 bp, Artificial sequence
  Synthetic oligonucleotide sequence
tgtgcttcctgctaacagttctaga

SEQ ID NO: 1532 - DNA, 25 bp, Artificial sequence
  Synthetic oligonucleotide sequence
tgatcagaatcatggtctcccgcag

SEQ ID NO: 1533 - DNA, 25 bp, Artificial sequence
  Synthetic oligonucleotide sequence
tgaccgactgtacgactccatgaag

SEQ ID NO: 1534 - DNA, 25 bp, Artificial sequence
  Synthetic oligonucleotide sequence
tgcctcttgtgtactgtgtcgtaaa

SEQ ID NO: 1535 - DNA, 25 bp, Artificial sequence
  Synthetic oligonucleotide sequence
tctagtctctccttttagccaaaga

SEQ ID NO: 1536 - DNA, 25 bp, Artificial sequence
  Synthetic oligonucleotide sequence
tattttagatgcctacgcgttaccc

SEQ ID NO: 1537 - DNA, 25 bp, Artificial sequence
  Synthetic oligonucleotide sequence
agggagcatactgattggtcttaaa

SEQ ID NO: 1538 - DNA, 25 bp, Artificial sequence
  Synthetic oligonucleotide sequence
aagctaccttttgtaagtgccatgt

SEQ ID NO: 1539 - DNA, 25 bp, Artificial sequence
  Synthetic oligonucleotide sequence
aagtgccatgtttatgacctaatca

SEQ ID NO: 1540 - DNA, 25 bp, Artificial sequence
  Synthetic oligonucleotide sequence
ccatgttggctgctgctgttgaaat

SEQ ID NO: 1541 - DNA, 25 bp, Artificial sequence
  Synthetic oligonucleotide sequence
gacctaatcattccaagttttgcat

SEQ ID NO: 1542 - DNA, 25 bp, Artificial sequence
  Synthetic oligonucleotide sequence
gacttattcatctttccagggagca

SEQ ID NO: 1543 - DNA, 25 bp, Artificial sequence
  Synthetic oligonucleotide sequence
gtggaatattctcataagctacctt

SEQ ID NO: 1544 - DNA, 25 bp, Artificial sequence
  Synthetic oligonucleotide sequence
ggtggccggaacatctatttttcta

SEQ ID NO: 1545 - DNA, 25 bp, Artificial sequence
  Synthetic oligonucleotide sequence
taagctgctaaaaccccatgttggc

SEQ ID NO: 1546 - DNA, 25 bp, Artificial sequence
  Synthetic oligonucleotide sequence
tgccactcctttctttcaaggacag

SEQ ID NO: 1547 - DNA, 25 bp, Artificial sequence
  Synthetic oligonucleotide sequence
ttgcattgatgtctgactgccactc

SEQ ID NO: 1548 - DNA, 25 bp, Artificial sequence
  Synthetic oligonucleotide sequence
atctacaagattggccagggctacc

SEQ ID NO: 1549 - DNA, 25 bp, Artificial sequence
  Synthetic oligonucleotide sequence
atggccgcttccagactgtggagga

SEQ ID NO: 1550 - DNA, 25 bp, Artificial sequence
  Synthetic oligonucleotide sequence
agggctacctcatcaaggacggcaa

SEQ ID NO: 1551 - DNA, 25 bp, Artificial sequence
  Synthetic oligonucleotide sequence
aggttgacctcaagttcatcgacac

SEQ ID NO: 1552 - DNA, 25 bp, Artificial sequence
  Synthetic oligonucleotide sequence
agaagcgagtgctgacccttcgcaa

SEQ ID NO: 1553 - DNA, 25 bp, Artificial sequence
  Synthetic oligonucleotide sequence
agaacaatgcctccactgattacga

SEQ ID NO: 1554 - DNA, 25 bp, Artificial sequence
  Synthetic oligonucleotide sequence
aagtccctgctggtgcagacgaagc

SEQ ID NO: 1555 - DNA, 25 bp, Artificial sequence
  Synthetic oligonucleotide sequence
gacaagagcatcaaccctctgggtg

SEQ ID NO: 1556 - DNA, 25 bp, Artificial sequence
  Synthetic oligonucleotide sequence
gaccaacgactttgtcatgctgaaa

SEQ ID NO: 1557 - DNA, 25 bp, Artificial sequence
  Synthetic oligonucleotide sequence
gatgccagcatcagatcgtgcagct

SEQ ID NO: 1558 - DNA, 25 bp, Artificial sequence
  Synthetic oligonucleotide sequence
gtggctttgtccactacggtgaagt

SEQ ID NO: 1559 - DNA, 25 bp, Artificial sequence
  Synthetic oligonucleotide sequence
atatatcgcattcgtgtgcgccgtg

SEQ ID NO: 1560 - DNA, 25 bp, Artificial sequence
  Synthetic oligonucleotide sequence
ataaggcgcgcagactgggctacaa

SEQ ID NO: 1561 - DNA, 25 bp, Artificial sequence
  Synthetic oligonucleotide sequence
agagggctgacatctgcaggccgca

SEQ ID NO: 1562 - DNA, 25 bp, Artificial sequence
  Synthetic oligonucleotide sequence
agctcaagtttgctcgaagccttca

SEQ ID NO: 1563 - DNA, 25 bp, Artificial sequence
  Synthetic oligonucleotide sequence
actattggtggttctcgccgtgcag

SEQ ID NO: 1564 - DNA, 25 bp, Artificial sequence
  Synthetic oligonucleotide sequence
aagccttcagtctgttgccgaggaa

SEQ ID NO: 1565 - DNA, 25 bp, Artificial sequence
  Synthetic oligonucleotide sequence
gcttcaccgttaccgctaatataag

SEQ ID NO: 1566 - DNA, 25 bp, Artificial sequence
  Synthetic oligonucleotide sequence
gcaagcctgtgcatcatggtgttaa

SEQ ID NO: 1567 - DNA, 25 bp, Artificial sequence
  Synthetic oligonucleotide sequence
gacgtgatgcgatttcttctcaggg

SEQ ID NO: 1568 - DNA, 25 bp, Artificial sequence
  Synthetic oligonucleotide sequence
gagaaggcgcaatactctgcagctt

SEQ ID NO: 1569 - DNA, 25 bp, Artificial sequence
  Synthetic oligonucleotide sequence
gaggtgatcctcattgatccattcc

SEQ ID NO: 1570 - DNA, 25 bp, Artificial sequence
  Synthetic oligonucleotide sequence
attacttctagcttggttcctacaa

SEQ ID NO: 1571 - DNA, 25 bp, Artificial sequence
  Synthetic oligonucleotide sequence
aggataatagagctcctctcctctg

SEQ ID NO: 1572 - DNA, 25 bp, Artificial sequence
  Synthetic oligonucleotide sequence
aaagtctgtcttgccactatgagta

SEQ ID NO: 1573 - DNA, 25 bp, Artificial sequence
  Synthetic oligonucleotide sequence
aatattttcttctctagcatcgcac

SEQ ID NO: 1574 - DNA, 25 bp, Artificial sequence
  Synthetic oligonucleotide sequence
ctagcatcgcactgtcattttttgt

SEQ ID NO: 1575 - DNA, 25 bp, Artificial sequence
  Synthetic oligonucleotide sequence
gttgggtctcaacattggctcaaga

SEQ ID NO: 1576 - DNA, 25 bp, Artificial sequence
  Synthetic oligonucleotide sequence
gtaacctagcctgagacaagtcctg

SEQ ID NO: 1577 - DNA, 25 bp, Artificial sequence
  Synthetic oligonucleotide sequence
ggcttatcatctgagaatgcgccat

SEQ ID NO: 1578 - DNA, 25 bp, Artificial sequence
  Synthetic oligonucleotide sequence
tgcgccatctttttctctggataat

SEQ ID NO: 1579 - DNA, 25 bp, Artificial sequence
  Synthetic oligonucleotide sequence
ttttttccagtcctgccatatctaa

SEQ ID NO: 1580 - DNA, 25 bp, Artificial sequence
  Synthetic oligonucleotide sequence
ttctgcagttgttttgcgtttcact

SEQ ID NO: 1581 - DNA, 25 bp, Artificial sequence
  Synthetic oligonucleotide sequence
acatgcaccttcaactgctcagaag

SEQ ID NO: 1582 - DNA, 25 bp, Artificial sequence
  Synthetic oligonucleotide sequence
aaacatttggctgatttttgctttt

SEQ ID NO: 1583 - DNA, 25 bp, Artificial sequence
  Synthetic oligonucleotide sequence
gcaggataccaagctctatgtttta

SEQ ID NO: 1584 - DNA, 25 bp, Artificial sequence
  Synthetic oligonucleotide sequence
gatcatcaggaatctggtccagcac

SEQ ID NO: 1585 - DNA, 25 bp, Artificial sequence
  Synthetic oligonucleotide sequence
gttggcatttatcatttggctggca

SEQ ID NO: 1586 - DNA, 25 bp, Artificial sequence
  Synthetic oligonucleotide sequence
gttttatagacatcagtccctggag

SEQ ID NO: 1587 - DNA, 25 bp, Artificial sequence
  Synthetic oligonucleotide sequence
gtgaagcagcccagtacatactttc

SEQ ID NO: 1588 - DNA, 25 bp, Artificial sequence
  Synthetic oligonucleotide sequence
gtcatggttactgcattatctgggt

SEQ ID NO: 1589 - DNA, 25 bp, Artificial sequence
  Synthetic oligonucleotide sequence
ggtccagcactagtccaatgtgtca

SEQ ID NO: 1590 - DNA, 25 bp, Artificial sequence
  Synthetic oligonucleotide sequence
tggacaggagtttcacggcgatcaa

SEQ ID NO: 1591 - DNA, 25 bp, Artificial sequence
  Synthetic oligonucleotide sequence
tcatccctgtggcagtcatggttac

SEQ ID NO: 1592 - DNA, 25 bp, Artificial sequence
  Synthetic oligonucleotide sequence
atatattttctattactgccaaaca

SEQ ID NO: 1593 - DNA, 25 bp, Artificial sequence
  Synthetic oligonucleotide sequence
atctcttttttgtggcatattttaa

SEQ ID NO: 1594 - DNA, 25 bp, Artificial sequence
  Synthetic oligonucleotide sequence
atgcaacaccagtttgactattctt

SEQ ID NO: 1595 - DNA, 25 bp, Artificial sequence
  Synthetic oligonucleotide sequence
aatgtgcacttaccaaaaaatctgt

SEQ ID NO: 1596 - DNA, 25 bp, Artificial sequence
  Synthetic oligonucleotide sequence
ccagtttgactattctttcttttag

SEQ ID NO: 1597 - DNA, 25 bp, Artificial sequence
  Synthetic oligonucleotide sequence
gtttgcatgctctgcttcggcggcc

SEQ ID NO: 1598 - DNA, 25 bp, Artificial sequence
  Synthetic oligonucleotide sequence
gtaacaatcggaagcatatttctat

SEQ ID NO: 1599 - DNA, 25 bp, Artificial sequence
  Synthetic oligonucleotide sequence
gtatgtctctattttcataatcagc

SEQ ID NO: 1600 - DNA, 25 bp, Artificial sequence
  Synthetic oligonucleotide sequence
gtacttttagaaatgtgcacttacc

SEQ ID NO: 1601 - DNA, 25 bp, Artificial sequence
  Synthetic oligonucleotide sequence
tgggcacagaccaggccacgctgtg

SEQ ID NO: 1602 - DNA, 25 bp, Artificial sequence
  Synthetic oligonucleotide sequence
ttcatttatctcttttttgtggcat

SEQ ID NO: 1603 - DNA, 25 bp, Artificial sequence
  Synthetic oligonucleotide sequence
ctcctcgttgctgtgtgcttaatta

SEQ ID NO: 1604 - DNA, 25 bp, Artificial sequence
  Synthetic oligonucleotide sequence
gaacacttaccttctctgattgttt

SEQ ID NO: 1605 - DNA, 25 bp, Artificial sequence
  Synthetic oligonucleotide sequence
gttgagcttagccactatgcacatt

SEQ ID NO: 1606 - DNA, 25 bp, Artificial sequence
  Synthetic oligonucleotide sequence
gttgacacggttgcacatttccaat

SEQ ID NO: 1607 - DNA, 25 bp, Artificial sequence
  Synthetic oligonucleotide sequence
gtaattattcattgtggctgtccag

SEQ ID NO: 1608 - DNA, 25 bp, Artificial sequence
  Synthetic oligonucleotide sequence
ggctgtccagttctatgatgcattc

SEQ ID NO: 1609 - DNA, 25 bp, Artificial sequence
  Synthetic oligonucleotide sequence
tgttactttggcttttttgtctccg

SEQ ID NO: 1610 - DNA, 25 bp, Artificial sequence
  Synthetic oligonucleotide sequence
tgaggcgtcgtaaccaagaacactt

SEQ ID NO: 1611 - DNA, 25 bp, Artificial sequence
  Synthetic oligonucleotide sequence
tcgatccacccctatgagagcaagt

SEQ ID NO: 1612 - DNA, 25 bp, Artificial sequence
  Synthetic oligonucleotide sequence
tgaaccgggcagtgacttggcgtct

SEQ ID NO: 1613 - DNA, 25 bp, Artificial sequence
  Synthetic oligonucleotide sequence
ttaattagtgttgccacggtgctgt

SEQ ID NO: 1614 - DNA, 25 bp, Artificial sequence
  Synthetic oligonucleotide sequence
attctttttcttttccagtatgaag

SEQ ID NO: 1615 - DNA, 25 bp, Artificial sequence
  Synthetic oligonucleotide sequence
atagctttcatacctacatttcaag

SEQ ID NO: 1616 - DNA, 25 bp, Artificial sequence
  Synthetic oligonucleotide sequence
atacctatctcagttattctttttc

SEQ ID NO: 1617 - DNA, 25 bp, Artificial sequence
  Synthetic oligonucleotide sequence
ccagtatgaagtttgctgaatgtac

SEQ ID NO: 1618 - DNA, 25 bp, Artificial sequence
  Synthetic oligonucleotide sequence
gctagacttattactgtgcacgaga

SEQ ID NO: 1619 - DNA, 25 bp, Artificial sequence
  Synthetic oligonucleotide sequence
gaagctgttcttgaactaacacgga

SEQ ID NO: 1620 - DNA, 25 bp, Artificial sequence
  Synthetic oligonucleotide sequence
gattgtcttgatttgatccgaaaca

SEQ ID NO: 1621 - DNA, 25 bp, Artificial sequence
  Synthetic oligonucleotide sequence
gggccgtgtcaggaaattacctata

SEQ ID NO: 1622 - DNA, 25 bp, Artificial sequence
  Synthetic oligonucleotide sequence
ggtgtagaagctcagctagacttat

SEQ ID NO: 1623 - DNA, 25 bp, Artificial sequence
  Synthetic oligonucleotide sequence
ggataatatcttcatgtttctgaaa

SEQ ID NO: 1624 - DNA, 25 bp, Artificial sequence
  Synthetic oligonucleotide sequence
tgtgcacgagagtaaatacctatct

SEQ ID NO: 1625 - DNA, 25 bp, Artificial sequence
  Synthetic oligonucleotide sequence
aaataatcttgcagtaccggagtat

SEQ ID NO: 1626 - DNA, 25 bp, Artificial sequence
  Synthetic oligonucleotide sequence
gaaacttttcctgtagagggccgct

SEQ ID NO: 1627 - DNA, 25 bp, Artificial sequence
  Synthetic oligonucleotide sequence
gcaaaagcattcatcagcagcgtgt

SEQ ID NO: 1628 - DNA, 25 bp, Artificial sequence
  Synthetic oligonucleotide sequence
gaaagtttcccacctgctaggaaag

SEQ ID NO: 1629 - DNA, 25 bp, Artificial sequence
  Synthetic oligonucleotide sequence
gaaatggcctcaggaaagtttccca

SEQ ID NO: 1630 - DNA, 25 bp, Artificial sequence
  Synthetic oligonucleotide sequence
gaccctgccgtcatcatgcaaaagc

SEQ ID NO: 1631 - DNA, 25 bp, Artificial sequence
  Synthetic oligonucleotide sequence
gagggccgctttgtaaatattttag

SEQ ID NO: 1632 - DNA, 25 bp, Artificial sequence
  Synthetic oligonucleotide sequence
gagggcaacacaatttctgtcgcaa

SEQ ID NO: 1633 - DNA, 25 bp, Artificial sequence
  Synthetic oligonucleotide sequence
tggccacttttgtcattcagcactt

SEQ ID NO: 1634 - DNA, 25 bp, Artificial sequence
  Synthetic oligonucleotide sequence
tgaattttacctgttttctactcta

SEQ ID NO: 1635 - DNA, 25 bp, Artificial sequence
  Synthetic oligonucleotide sequence
tacctatctaatacagcagccactg

SEQ ID NO: 1636 - DNA, 25 bp, Artificial sequence
  Synthetic oligonucleotide sequence
aacactaatttgtgtgcagctatta

SEQ ID NO: 1637 - DNA, 25 bp, Artificial sequence
  Synthetic oligonucleotide sequence
aattgactactgtaaattttccaca

SEQ ID NO: 1638 - DNA, 25 bp, Artificial sequence
  Synthetic oligonucleotide sequence
aattgtgaccttttctaaagctgaa

SEQ ID NO: 1639 - DNA, 25 bp, Artificial sequence
  Synthetic oligonucleotide sequence
gaaagggaaccatattgacagtttt

SEQ ID NO: 1640 - DNA, 25 bp, Artificial sequence
  Synthetic oligonucleotide sequence
gacagttttagttctgtgaacacta

SEQ ID NO: 1641 - DNA, 25 bp, Artificial sequence
  Synthetic oligonucleotide sequence
gagactattgtacgtgctttcagca

SEQ ID NO: 1642 - DNA, 25 bp, Artificial sequence
  Synthetic oligonucleotide sequence
gttgacttcaataactacagaccaa

SEQ ID NO: 1643 - DNA, 25 bp, Artificial sequence
  Synthetic oligonucleotide sequence
gtttgactcaggtttgttgacttca

SEQ ID NO: 1644 - DNA, 25 bp, Artificial sequence
  Synthetic oligonucleotide sequence
gtatagcatagtaattctactccaa

SEQ ID NO: 1645 - DNA, 25 bp, Artificial sequence
  Synthetic oligonucleotide sequence
gtgctttcagcaaaacatcttattc

SEQ ID NO: 1646 - DNA, 25 bp, Artificial sequence
  Synthetic oligonucleotide sequence
ggagggctaccttgagactattgta

SEQ ID NO: 1647 - DNA, 25 bp, Artificial sequence
  Synthetic oligonucleotide sequence
attcagatcttttcagctgttcttg

SEQ ID NO: 1648 - DNA, 25 bp, Artificial sequence
  Synthetic oligonucleotide sequence
atcatactgtggttctaggttatca

SEQ ID NO: 1649 - DNA, 25 bp, Artificial sequence
  Synthetic oligonucleotide sequence
aggaaaactcctctctgtagcacca

SEQ ID NO: 1650 - DNA, 25 bp, Artificial sequence
  Synthetic oligonucleotide sequence
agtgcctggccatatgcccagcaaa

SEQ ID NO: 1651 - DNA, 25 bp, Artificial sequence
  Synthetic oligonucleotide sequence
aaagcaaactttttcctgtagagag

SEQ ID NO: 1652 - DNA, 25 bp, Artificial sequence
  Synthetic oligonucleotide sequence
aagcaagcacagaccgttcagcgta

SEQ ID NO: 1653 - DNA, 25 bp, Artificial sequence
  Synthetic oligonucleotide sequence
ctgtagcaccatttctgtttctgag

SEQ ID NO: 1654 - DNA, 25 bp, Artificial sequence
  Synthetic oligonucleotide sequence
gaagttttttcatgtgttcccaaat

SEQ ID NO: 1655 - DNA, 25 bp, Artificial sequence
  Synthetic oligonucleotide sequence
gttagtgcagctccagaactgtcat

SEQ ID NO: 1656 - DNA, 25 bp, Artificial sequence
  Synthetic oligonucleotide sequence
tcagctgttcttgggccgttataaa

SEQ ID NO: 1657 - DNA, 25 bp, Artificial sequence
  Synthetic oligonucleotide sequence
tttgatttacccttcatccattggc

SEQ ID NO: 1658 - DNA, 25 bp, Artificial sequence
  Synthetic oligonucleotide sequence
agccgacccgtttgcagtgaatttt

SEQ ID NO: 1659 - DNA, 25 bp, Artificial sequence
  Synthetic oligonucleotide sequence
attttctgccgatctcttctttttt

SEQ ID NO: 1660 - DNA, 25 bp, Artificial sequence
  Synthetic oligonucleotide sequence
aaagcccagcacttgaattgttctt

SEQ ID NO: 1661 - DNA, 25 bp, Artificial sequence
  Synthetic oligonucleotide sequence
aaactttcccagatattctcagccg

SEQ ID NO: 1662 - DNA, 25 bp, Artificial sequence
  Synthetic oligonucleotide sequence
gagtcctgtttcgttttattttctg

SEQ ID NO: 1663 - DNA, 25 bp, Artificial sequence
  Synthetic oligonucleotide sequence
gatgagtggcttctctgtgatcacc

SEQ ID NO: 1664 - DNA, 25 bp, Artificial sequence
  Synthetic oligonucleotide sequence
gtcatctaacgtttgtcattccagt

SEQ ID NO: 1665 - DNA, 25 bp, Artificial sequence
  Synthetic oligonucleotide sequence
tgtgatcacctgtcacgattcgtgg

SEQ ID NO: 1666 - DNA, 25 bp, Artificial sequence
  Synthetic oligonucleotide sequence
tgaattttcatttccttccttcttg

SEQ ID NO: 1667 - DNA, 25 bp, Artificial sequence
  Synthetic oligonucleotide sequence
ttgccccttgttgtaaaaagcccag

SEQ ID NO: 1668 - DNA, 25 bp, Artificial sequence
  Synthetic oligonucleotide sequence
ttggtcgagtgttcggcagagccac

SEQ ID NO: 1669 - DNA, 25 bp, Artificial sequence
  Synthetic oligonucleotide sequence
ggtcttggaacataggaggtgctca

SEQ ID NO: 1670 - DNA, 25 bp, Artificial sequence
  Synthetic oligonucleotide sequence
atttttggccatatttcacttagtt

SEQ ID NO: 1671 - DNA, 25 bp, Artificial sequence
  Synthetic oligonucleotide sequence
agtattcccgtattgcattttgcta

SEQ ID NO: 1672 - DNA, 25 bp, Artificial sequence
  Synthetic oligonucleotide sequence
actcactttttaactgtacaccttg

SEQ ID NO: 1673 - DNA, 25 bp, Artificial sequence
  Synthetic oligonucleotide sequence
aaatgtattgtttcaactcactttt

SEQ ID NO: 1674 - DNA, 25 bp, Artificial sequence
  Synthetic oligonucleotide sequence
aaatactagttgactgcacagcgag

SEQ ID NO: 1675 - DNA, 25 bp, Artificial sequence
  Synthetic oligonucleotide sequence
aatgcatgatgattatttttggcca

SEQ ID NO: 1676 - DNA, 25 bp, Artificial sequence
  Synthetic oligonucleotide sequence
gactgcacagcgagtagtgtactaa

SEQ ID NO: 1677 - DNA, 25 bp, Artificial sequence
  Synthetic oligonucleotide sequence
gagatgtccttattgggtaaccatg

SEQ ID NO: 1678 - DNA, 25 bp, Artificial sequence
  Synthetic oligonucleotide sequence
gtacaccttgtagttattttctatt

SEQ ID NO: 1679 - DNA, 25 bp, Artificial sequence
  Synthetic oligonucleotide sequence
tatttcacttagttttttcaggcta

SEQ ID NO: 1680 - DNA, 25 bp, Artificial sequence
  Synthetic oligonucleotide sequence
attgccaggacagttccaggctctg

SEQ ID NO: 1681 - DNA, 25 bp, Artificial sequence
  Synthetic oligonucleotide sequence
ataacttctttttgcagtggtgtgc

SEQ ID NO: 1682 - DNA, 25 bp, Artificial sequence
  Synthetic oligonucleotide sequence
agcgtaatcagggattgggccccac

SEQ ID NO: 1683 - DNA, 25 bp, Artificial sequence
  Synthetic oligonucleotide sequence
cagtggtgtgctttgaaatttgtca

SEQ ID NO: 1684 - DNA, 25 bp, Artificial sequence
  Synthetic oligonucleotide sequence
gctctggagctaactaagccatcaa

SEQ ID NO: 1685 - DNA, 25 bp, Artificial sequence
  Synthetic oligonucleotide sequence
gaaatgcttagctataggactggga

SEQ ID NO: 1686 - DNA, 25 bp, Artificial sequence
  Synthetic oligonucleotide sequence
gatgtatataaccacagttcccata

SEQ ID NO: 1687 - DNA, 25 bp, Artificial sequence
  Synthetic oligonucleotide sequence
gtcttatttctatactctgcctgat

SEQ ID NO: 1688 - DNA, 25 bp, Artificial sequence
  Synthetic oligonucleotide sequence
gtgtgcatgtctatgtgagcgtaat

SEQ ID NO: 1689 - DNA, 25 bp, Artificial sequence
  Synthetic oligonucleotide sequence
ggaagagccaactcacctgaaagaa

SEQ ID NO: 1690 - DNA, 25 bp, Artificial sequence
  Synthetic oligonucleotide sequence
ttgggccccactcttggtaaataca

SEQ ID NO: 1691 - DNA, 25 bp, Artificial sequence
  Synthetic oligonucleotide sequence
aattccaacaggcttttaccattag

SEQ ID NO: 1692 - DNA, 25 bp, Artificial sequence
  Synthetic oligonucleotide sequence
atgctttcaagcctgtgttcacttt

SEQ ID NO: 1693 - DNA, 25 bp, Artificial sequence
  Synthetic oligonucleotide sequence
actagagggtgaacgctgctgttga

SEQ ID NO: 1694 - DNA, 25 bp, Artificial sequence
  Synthetic oligonucleotide sequence
aacgctgctgttgatgctttcaagc

SEQ ID NO: 1695 - DNA, 25 bp, Artificial sequence
  Synthetic oligonucleotide sequence
aatccatttttaaagctgtgtgaat

SEQ ID NO: 1696 - DNA, 25 bp, Artificial sequence
  Synthetic oligonucleotide sequence
gagcgttaaaacaattgccataaag

SEQ ID NO: 1697 - DNA, 25 bp, Artificial sequence
  Synthetic oligonucleotide sequence
gagagcacatgttcatatagcaatg

SEQ ID NO: 1698 - DNA, 25 bp, Artificial sequence
  Synthetic oligonucleotide sequence
gtcacatcagtttgatatcagtgtt

SEQ ID NO: 1699 - DNA, 25 bp, Artificial sequence
  Synthetic oligonucleotide sequence
gtgcactaccattgtcacatcagtt

SEQ ID NO: 1700 - DNA, 25 bp, Artificial sequence
  Synthetic oligonucleotide sequence
gtgttcacttttccagagcgttaaa

SEQ ID NO: 1701 - DNA, 25 bp, Artificial sequence
  Synthetic oligonucleotide sequence
ttcattttgaattgtgtgcactacc

SEQ ID NO: 1702 - DNA, 25 bp, Artificial sequence
  Synthetic oligonucleotide sequence
atttgggcttctaactgcagcgttt

SEQ ID NO: 1703 - DNA, 25 bp, Artificial sequence
  Synthetic oligonucleotide sequence
attttgattatgttgcttaccttga

SEQ ID NO: 1704 - DNA, 25 bp, Artificial sequence
  Synthetic oligonucleotide sequence
ataatttagtgtctctggcacacac

SEQ ID NO: 1705 - DNA, 25 bp, Artificial sequence
  Synthetic oligonucleotide sequence
atgttttcacattcctttgtccgga

SEQ ID NO: 1706 - DNA, 25 bp, Artificial sequence
  Synthetic oligonucleotide sequence
acttcagttgtgatcttggtgacat

SEQ ID NO: 1707 - DNA, 25 bp, Artificial sequence
  Synthetic oligonucleotide sequence
aactcagcatccttgttttctgcaa

SEQ ID NO: 1708 - DNA, 25 bp, Artificial sequence
  Synthetic oligonucleotide sequence
ccatgtctttgttgtacttgtgcag

SEQ ID NO: 1709 - DNA, 25 bp, Artificial sequence
  Synthetic oligonucleotide sequence
gacatatctgttggcttaggtttta

SEQ ID NO: 1710 - DNA, 25 bp, Artificial sequence
  Synthetic oligonucleotide sequence
gatgcttttgttttgggttatggtc

SEQ ID NO: 1711 - DNA, 25 bp, Artificial sequence
  Synthetic oligonucleotide sequence
ttatcgcagatgttcggttgaccaa

SEQ ID NO: 1712 - DNA, 25 bp, Artificial sequence
  Synthetic oligonucleotide sequence
ttgtaattaccttcccatgtctttg

SEQ ID NO: 1713 - DNA, 25 bp, Artificial sequence
  Synthetic oligonucleotide sequence
agtgattcagttttctatagcttac

SEQ ID NO: 1714 - DNA, 25 bp, Artificial sequence
  Synthetic oligonucleotide sequence
accactgcaagaggacgctgagatt

SEQ ID NO: 1715 - DNA, 25 bp, Artificial sequence
  Synthetic oligonucleotide sequence
accctatttctcactgtcttcatta

SEQ ID NO: 1716 - DNA, 25 bp, Artificial sequence
  Synthetic oligonucleotide sequence
actgtcttcattatttcacgtagga

SEQ ID NO: 1717 - DNA, 25 bp, Artificial sequence
  Synthetic oligonucleotide sequence
aaagccttgttattatttgatccta

SEQ ID NO: 1718 - DNA, 25 bp, Artificial sequence
  Synthetic oligonucleotide sequence
cacttctaacctgaaagctgcttgg

SEQ ID NO: 1719 - DNA, 25 bp, Artificial sequence
  Synthetic oligonucleotide sequence
caaaatggatctgtgcgctgtggca

SEQ ID NO: 1720 - DNA, 25 bp, Artificial sequence
  Synthetic oligonucleotide sequence
gattttctatgtcttccacttctaa

SEQ ID NO: 1721 - DNA, 25 bp, Artificial sequence
  Synthetic oligonucleotide sequence
gtgcgctgtggcagaactgttattt

SEQ ID NO: 1722 - DNA, 25 bp, Artificial sequence
  Synthetic oligonucleotide sequence
ggattttacagctcaactaacagtg

SEQ ID NO: 1723 - DNA, 25 bp, Artificial sequence
  Synthetic oligonucleotide sequence
tacagtttattttttgcacacccta

SEQ ID NO: 1724 - DNA, 25 bp, Artificial sequence
  Synthetic oligonucleotide sequence
accgactgacgcctcaggaggaaat

SEQ ID NO: 1725 - DNA, 25 bp, Artificial sequence
  Synthetic oligonucleotide sequence
gctgagaactccaggcaccgactga

SEQ ID NO: 1726 - DNA, 25 bp, Artificial sequence
  Synthetic oligonucleotide sequence
agggcaggctgagaactccaggcac

SEQ ID NO: 1727 - DNA, 25 bp, Artificial sequence
  Synthetic oligonucleotide sequence
agtcttaaagatgggctgctattgg

SEQ ID NO: 1728 - DNA, 25 bp, Artificial sequence
  Synthetic oligonucleotide sequence
agaaagggcagcctctaccctaagc

SEQ ID NO: 1729 - DNA, 25 bp, Artificial sequence
  Synthetic oligonucleotide sequence
acgcctaccccactgaggtactgaa

SEQ ID NO: 1730 - DNA, 25 bp, Artificial sequence
  Synthetic oligonucleotide sequence
ctggtcaaagaaccccagctggtgt

SEQ ID NO: 1731 - DNA, 25 bp, Artificial sequence
  Synthetic oligonucleotide sequence
ggacttcttccccagtcttaaagat

SEQ ID NO: 1732 - DNA, 25 bp, Artificial sequence
  Synthetic oligonucleotide sequence
tgcattccacaaaggcggctccaga

SEQ ID NO: 1733 - DNA, 25 bp, Artificial sequence
  Synthetic oligonucleotide sequence
tgaggtactgaagcccatcagccag

SEQ ID NO: 1734 - DNA, 25 bp, Artificial sequence
  Synthetic oligonucleotide sequence
taagcctaaagcctgctgggtgtcc

SEQ ID NO: 1735 - DNA, 25 bp, Artificial sequence
  Synthetic oligonucleotide sequence
aatgtggtgcacactatagcctcac

SEQ ID NO: 1736 - DNA, 25 bp, Artificial sequence
  Synthetic oligonucleotide sequence
gaaatagctctctgtgctgtttgaa

SEQ ID NO: 1737 - DNA, 25 bp, Artificial sequence
  Synthetic oligonucleotide sequence
gagtagctcccttcatctggaagat

SEQ ID NO: 1738 - DNA, 25 bp, Artificial sequence
  Synthetic oligonucleotide sequence
gtataacctgcagtgtcctaactaa

SEQ ID NO: 1739 - DNA, 25 bp, Artificial sequence
  Synthetic oligonucleotide sequence
gtaggagcactacaccattggttcc

SEQ ID NO: 1740 - DNA, 25 bp, Artificial sequence
  Synthetic oligonucleotide sequence
ggttccctaccctacatgtaagaga

SEQ ID NO: 1741 - DNA, 25 bp, Artificial sequence
  Synthetic oligonucleotide sequence
gtgtcatgtttgcttcttgaatctg

SEQ ID NO: 1742 - DNA, 25 bp, Artificial sequence
  Synthetic oligonucleotide sequence
tagaatatttctcttatcccctttt

SEQ ID NO: 1743 - DNA, 25 bp, Artificial sequence
  Synthetic oligonucleotide sequence
tagcctcacaaacctgttattccag

SEQ ID NO: 1744 - DNA, 25 bp, Artificial sequence
  Synthetic oligonucleotide sequence
tttagtgaaaatccctcattctggc

SEQ ID NO: 1745 - DNA, 25 bp, Artificial sequence
  Synthetic oligonucleotide sequence
ttactggcttggtcttatctgcaca

SEQ ID NO: 1746 - DNA, 25 bp, Artificial sequence
  Synthetic oligonucleotide sequence
atgcctatcatgacacttctttcta

SEQ ID NO: 1747 - DNA, 25 bp, Artificial sequence
  Synthetic oligonucleotide sequence
aaactgctctctcttccaaagggat

SEQ ID NO: 1748 - DNA, 25 bp, Artificial sequence
  Synthetic oligonucleotide sequence
aaacattttccttccttggaggctg

SEQ ID NO: 1749 - DNA, 25 bp, Artificial sequence
  Synthetic oligonucleotide sequence
aacgcgtcacttgtgagcctgcaga

SEQ ID NO: 1750 - DNA, 25 bp, Artificial sequence
  Synthetic oligonucleotide sequence
aatggtccagcttttcaattccacc

SEQ ID NO: 1751 - DNA, 25 bp, Artificial sequence
  Synthetic oligonucleotide sequence
ctgcagaaccttctagggccttata

SEQ ID NO: 1752 - DNA, 25 bp, Artificial sequence
  Synthetic oligonucleotide sequence
gaattttctttgttgcttcagatga

SEQ ID NO: 1753 - DNA, 25 bp, Artificial sequence
  Synthetic oligonucleotide sequence
ggaagcagcagcactttcctggtct

SEQ ID NO: 1754 - DNA, 25 bp, Artificial sequence
  Synthetic oligonucleotide sequence
tcctacctacagacttttttgacag

SEQ ID NO: 1755 - DNA, 25 bp, Artificial sequence
  Synthetic oligonucleotide sequence
tccaagatttcagtgatttcccctc

SEQ ID NO: 1756 - DNA, 25 bp, Artificial sequence
  Synthetic oligonucleotide sequence
tttctattttctctgtgctttggct

SEQ ID NO: 1757 - DNA, 25 bp, Artificial sequence
  Synthetic oligonucleotide sequence
attcctctgtgttttatgttactgt

SEQ ID NO: 1758 - DNA, 25 bp, Artificial sequence
  Synthetic oligonucleotide sequence
atctgattcccctaaatgcgtagaa

SEQ ID NO: 1759 - DNA, 25 bp, Artificial sequence
  Synthetic oligonucleotide sequence
atcactattttcactttgactgaca

SEQ ID NO: 1760 - DNA, 25 bp, Artificial sequence
  Synthetic oligonucleotide sequence
agaggcattagtggctttggctaaa

SEQ ID NO: 1761 - DNA, 25 bp, Artificial sequence
  Synthetic oligonucleotide sequence
caaactacttacctgattgtcaaga

SEQ ID NO: 1762 - DNA, 25 bp, Artificial sequence
  Synthetic oligonucleotide sequence
aagcattgctgtatctatttttgaa

SEQ ID NO: 1763 - DNA, 25 bp, Artificial sequence
  Synthetic oligonucleotide sequence
caagttatgctgtttcctctattct

SEQ ID NO: 1764 - DNA, 25 bp, Artificial sequence
  Synthetic oligonucleotide sequence
gacctgttaggcaaaatcactattt

SEQ ID NO: 1765 - DNA, 25 bp, Artificial sequence
  Synthetic oligonucleotide sequence
taagacacttgatgtattcctctgt

SEQ ID NO: 1766 - DNA, 25 bp, Artificial sequence
  Synthetic oligonucleotide sequence
tagagactctttcatccataagccc

SEQ ID NO: 1767 - DNA, 25 bp, Artificial sequence
  Synthetic oligonucleotide sequence
tttaacaaagctaaccacatcccct

SEQ ID NO: 1768 - DNA, 25 bp, Artificial sequence
  Synthetic oligonucleotide sequence
aaatcatcataactcaactcctacg

SEQ ID NO: 1769 - DNA, 25 bp, Artificial sequence
  Synthetic oligonucleotide sequence
aactttgtgtcagcgatacccttta

SEQ ID NO: 1770 - DNA, 25 bp, Artificial sequence
  Synthetic oligonucleotide sequence
aactattatctcatcctctttttcg

SEQ ID NO: 1771 - DNA, 25 bp, Artificial sequence
  Synthetic oligonucleotide sequence
aatacagggttggtgctctcatcta

SEQ ID NO: 1772 - DNA, 25 bp, Artificial sequence
  Synthetic oligonucleotide sequence
gaagtacttcgtgggctatctggga

SEQ ID NO: 1773 - DNA, 25 bp, Artificial sequence
  Synthetic oligonucleotide sequence
gaaacgcatcatactgttcctgttc

SEQ ID NO: 1774 - DNA, 25 bp, Artificial sequence
  Synthetic oligonucleotide sequence
gagttaaccttgcttttcctggaag

SEQ ID NO: 1775 - DNA, 25 bp, Artificial sequence
  Synthetic oligonucleotide sequence
gatccattctgtgtgtttcttgact

SEQ ID NO: 1776 - DNA, 25 bp, Artificial sequence
  Synthetic oligonucleotide sequence
tgggcttcgcgtcttgagttaacct

SEQ ID NO: 1777 - DNA, 25 bp, Artificial sequence
  Synthetic oligonucleotide sequence
tacggtcctctttagattgctgtaa

SEQ ID NO: 1778 - DNA, 25 bp, Artificial sequence
  Synthetic oligonucleotide sequence
ttgacttaccctgctttctgaagat

SEQ ID NO: 1779 - DNA, 25 bp, Artificial sequence
  Synthetic oligonucleotide sequence
agctgaaacacatctcttgggtcct

SEQ ID NO: 1780 - DNA, 25 bp, Artificial sequence
  Synthetic oligonucleotide sequence
gcttcccatcatagttttgccgtta

SEQ ID NO: 1781 - DNA, 25 bp, Artificial sequence
  Synthetic oligonucleotide sequence
gattcccagaatgccatcgatgacc

SEQ ID NO: 1782 - DNA, 25 bp, Artificial sequence
  Synthetic oligonucleotide sequence
gttccgttttcaaggaccagtcagc

SEQ ID NO: 1783 - DNA, 25 bp, Artificial sequence
  Synthetic oligonucleotide sequence
gtaacagtgactcctgattcccaga

SEQ ID NO: 1784 - DNA, 25 bp, Artificial sequence
  Synthetic oligonucleotide sequence
gtgtgagcagctcctcctgtatagt

SEQ ID NO: 1785 - DNA, 25 bp, Artificial sequence
  Synthetic oligonucleotide sequence
tggagcttttgcctgtagcttgaga

SEQ ID NO: 1786 - DNA, 25 bp, Artificial sequence
  Synthetic oligonucleotide sequence
tgtatagtcctcttcttcactgaat

SEQ ID NO: 1787 - DNA, 25 bp, Artificial sequence
  Synthetic oligonucleotide sequence
tcagtacgtcagtggtggagctttt

SEQ ID NO: 1788 - DNA, 25 bp, Artificial sequence
  Synthetic oligonucleotide sequence
ttcactgaatgctggaacctccaac

SEQ ID NO: 1789 - DNA, 25 bp, Artificial sequence
  Synthetic oligonucleotide sequence
tttacccgcagtatcaagcacaaga

SEQ ID NO: 1790 - DNA, 25 bp, Artificial sequence
  Synthetic oligonucleotide sequence
agatttgacctgttcatgcgtctgt

SEQ ID NO: 1791 - DNA, 25 bp, Artificial sequence
  Synthetic oligonucleotide sequence
tccgtctcccggctatatagtaatc

SEQ ID NO: 1792 - DNA, 25 bp, Artificial sequence
  Synthetic oligonucleotide sequence
gagttgtcattttctcttcactgga

SEQ ID NO: 1793 - DNA, 25 bp, Artificial sequence
  Synthetic oligonucleotide sequence
gttcatgcgtctgtggagcagccct

SEQ ID NO: 1794 - DNA, 25 bp, Artificial sequence
  Synthetic oligonucleotide sequence
gtaatcttaggtagagtgttgcctt

SEQ ID NO: 1795 - DNA, 25 bp, Artificial sequence
  Synthetic oligonucleotide sequence
gtcattttctcttcactggatgttt

SEQ ID NO: 1796 - DNA, 25 bp, Artificial sequence
  Synthetic oligonucleotide sequence
tagagtgttgccttgtgggttaccg

SEQ ID NO: 1797 - DNA, 25 bp, Artificial sequence
  Synthetic oligonucleotide sequence
tgggttaccgtttgctctgagactt

SEQ ID NO: 1798 - DNA, 25 bp, Artificial sequence
  Synthetic oligonucleotide sequence
tctgagacttctcggatggacccac

SEQ ID NO: 1799 - DNA, 25 bp, Artificial sequence
  Synthetic oligonucleotide sequence
tctcttcactggatgtttatttata

SEQ ID NO: 1800 - DNA, 25 bp, Artificial sequence
  Synthetic oligonucleotide sequence
tatgctctgtgtataaggatgaatt

SEQ ID NO: 1801 - DNA, 25 bp, Artificial sequence
  Synthetic oligonucleotide sequence
atggcacacgagtcaacatcactag

SEQ ID NO: 1802 - DNA, 25 bp, Artificial sequence
  Synthetic oligonucleotide sequence
accgatctgtggtggatggccaaca

SEQ ID NO: 1803 - DNA, 25 bp, Artificial sequence
  Synthetic oligonucleotide sequence
actagtttgccctgagctgagtgaa

SEQ ID NO: 1804 - DNA, 25 bp, Artificial sequence
  Synthetic oligonucleotide sequence
aagacagaagctgccctgacttaca

SEQ ID NO: 1805 - DNA, 25 bp, Artificial sequence
  Synthetic oligonucleotide sequence
gaaacgcctcgtactgctatgaaat

SEQ ID NO: 1806 - DNA, 25 bp, Artificial sequence
  Synthetic oligonucleotide sequence
gaaatatcgaactccgtgtccagaa

SEQ ID NO: 1807 - DNA, 25 bp, Artificial sequence
  Synthetic oligonucleotide sequence
gatgcgggctattacagctgtgtca

SEQ ID NO: 1808 - DNA, 25 bp, Artificial sequence
  Synthetic oligonucleotide sequence
gtgtcatgaccttgatccacaatgg

SEQ ID NO: 1809 - DNA, 25 bp, Artificial sequence
  Synthetic oligonucleotide sequence
ggacaatgctctctggattttgccg

SEQ ID NO: 1810 - DNA, 25 bp, Artificial sequence
  Synthetic oligonucleotide sequence
taaggtgtttctgggagccggcaca

SEQ ID NO: 1811 - DNA, 25 bp, Artificial sequence
  Synthetic oligonucleotide sequence
ttgtcaacctctggcttactagttt

SEQ ID NO: 1812 - DNA, 25 bp, Artificial sequence
  Synthetic oligonucleotide sequence
actgtttctggcacccactgaaaaa

SEQ ID NO: 1813 - DNA, 25 bp, Artificial sequence
  Synthetic oligonucleotide sequence
acatggtctgacctgcactgtttct

SEQ ID NO: 1814 - DNA, 25 bp, Artificial sequence
  Synthetic oligonucleotide sequence
acaactgccttctccatgtttatac

SEQ ID NO: 1815 - DNA, 25 bp, Artificial sequence
  Synthetic oligonucleotide sequence
gcttttccagattttagtctccttt

SEQ ID NO: 1816 - DNA, 25 bp, Artificial sequence
  Synthetic oligonucleotide sequence
gaaaactactgtggcctttctgctt

SEQ ID NO: 1817 - DNA, 25 bp, Artificial sequence
  Synthetic oligonucleotide sequence
gagttggttcatcccatttgaggac

SEQ ID NO: 1818 - DNA, 25 bp, Artificial sequence
  Synthetic oligonucleotide sequence
gagggagtctattttcactcattct

SEQ ID NO: 1819 - DNA, 25 bp, Artificial sequence
  Synthetic oligonucleotide sequence
gtggcttttgcctaacacttttgca

SEQ ID NO: 1820 - DNA, 25 bp, Artificial sequence
  Synthetic oligonucleotide sequence
tgtcttcccatattcatacctgcat

SEQ ID NO: 1821 - DNA, 25 bp, Artificial sequence
  Synthetic oligonucleotide sequence
tgcctttctcaccattttggtttga

SEQ ID NO: 1822 - DNA, 25 bp, Artificial sequence
  Synthetic oligonucleotide sequence
taaacttctctgcactccatgatgg

SEQ ID NO: 1823 - DNA, 25 bp, Artificial sequence
  Synthetic oligonucleotide sequence
aacattaagcactgttggcctcctg

SEQ ID NO: 1824 - DNA, 25 bp, Artificial sequence
  Synthetic oligonucleotide sequence
aagatgctcatccaggtcatcctga

SEQ ID NO: 1825 - DNA, 25 bp, Artificial sequence
  Synthetic oligonucleotide sequence
ctggtgcccagtgatcggaggtcca

SEQ ID NO: 1826 - DNA, 25 bp, Artificial sequence
  Synthetic oligonucleotide sequence
gccgtgatcatctcttgcctaagat

SEQ ID NO: 1827 - DNA, 25 bp, Artificial sequence
  Synthetic oligonucleotide sequence
gacaaattcacagctctcacaggaa

SEQ ID NO: 1828 - DNA, 25 bp, Artificial sequence
  Synthetic oligonucleotide sequence
gaaacagtgttctcaaccttgacaa

SEQ ID NO: 1829 - DNA, 25 bp, Artificial sequence
  Synthetic oligonucleotide sequence
gagggccccatttgagaaagtccgc

SEQ ID NO: 1830 - DNA, 25 bp, Artificial sequence
  Synthetic oligonucleotide sequence
gtccaggtggagatgccgtgatcat

SEQ ID NO: 1831 - DNA, 25 bp, Artificial sequence
  Synthetic oligonucleotide sequence
ggtcctaaattattttctctctcct

SEQ ID NO: 1832 - DNA, 25 bp, Artificial sequence
  Synthetic oligonucleotide sequence
ggatcccttactgtgatgtttgttc

SEQ ID NO: 1833 - DNA, 25 bp, Artificial sequence
  Synthetic oligonucleotide sequence
ttccttctgcagtctttagggtgaa

SEQ ID NO: 1834 - DNA, 25 bp, Artificial sequence
  Synthetic oligonucleotide sequence
atccgtacctaccaagagcacagag

SEQ ID NO: 1835 - DNA, 25 bp, Artificial sequence
  Synthetic oligonucleotide sequence
atgagcaggtaaagccaacgttttt

SEQ ID NO: 1836 - DNA, 25 bp, Artificial sequence
  Synthetic oligonucleotide sequence
agggaccttgctgcctttgataaat

SEQ ID NO: 1837 - DNA, 25 bp, Artificial sequence
  Synthetic oligonucleotide sequence
ctgtgactgccatgctggtgggaaa

SEQ ID NO: 1838 - DNA, 25 bp, Artificial sequence
  Synthetic oligonucleotide sequence
ctgattccacacatttctctttttt

SEQ ID NO: 1839 - DNA, 25 bp, Artificial sequence
  Synthetic oligonucleotide sequence
gactatgggtttggcaggacttctg

SEQ ID NO: 1840 - DNA, 25 bp, Artificial sequence
  Synthetic oligonucleotide sequence
gagcaagtatgcaccctgtgactgc

SEQ ID NO: 1841 - DNA, 25 bp, Artificial sequence
  Synthetic oligonucleotide sequence
gtcgttatccatctttctttttctt

SEQ ID NO: 1842 - DNA, 25 bp, Artificial sequence
  Synthetic oligonucleotide sequence
ggttaatctgtttgcttttcactta

SEQ ID NO: 1843 - DNA, 25 bp, Artificial sequence
  Synthetic oligonucleotide sequence
taaatcccatgatcaagccatccgt

SEQ ID NO: 1844 - DNA, 25 bp, Artificial sequence
  Synthetic oligonucleotide sequence
taaggacctgcctattgctgattcc

SEQ ID NO: 1845 - DNA, 25 bp, Artificial sequence
  Synthetic oligonucleotide sequence
agcgaatactccctgcagcagacga

SEQ ID NO: 1846 - DNA, 25 bp, Artificial sequence
  Synthetic oligonucleotide sequence
aatttcttagaacaccatttgggct

SEQ ID NO: 1847 - DNA, 25 bp, Artificial sequence
  Synthetic oligonucleotide sequence
acgagagacggcagcgtgttccttg

SEQ ID NO: 1848 - DNA, 25 bp, Artificial sequence
  Synthetic oligonucleotide sequence
accatttgggctagtttctgtgtaa

SEQ ID NO: 1849 - DNA, 25 bp, Artificial sequence
  Synthetic oligonucleotide sequence
aaattgtctagctctggcaaaacat

SEQ ID NO: 1850 - DNA, 25 bp, Artificial sequence
  Synthetic oligonucleotide sequence
ctaaaagctcctactgtgatgtgaa

SEQ ID NO: 1851 - DNA, 25 bp, Artificial sequence
  Synthetic oligonucleotide sequence
gaagtcttcagcatgctacgtgacg

SEQ ID NO: 1852 - DNA, 25 bp, Artificial sequence
  Synthetic oligonucleotide sequence
gacgaagatggaagaccttactccc

SEQ ID NO: 1853 - DNA, 25 bp, Artificial sequence
  Synthetic oligonucleotide sequence
gttcttatctcatttgttacgttcc

SEQ ID NO: 1854 - DNA, 25 bp, Artificial sequence
  Synthetic oligonucleotide sequence
gtgttccttgttcccaagagcagga

SEQ ID NO: 1855 - DNA, 25 bp, Artificial sequence
  Synthetic oligonucleotide sequence
ggaagatgaccttttgagctagtgt

SEQ ID NO: 1856 - DNA, 25 bp, Artificial sequence
  Synthetic oligonucleotide sequence
atctctatcaggaatactgcctcag

SEQ ID NO: 1857 - DNA, 25 bp, Artificial sequence
  Synthetic oligonucleotide sequence
atgctggcacatcattttgctggag

SEQ ID NO: 1858 - DNA, 25 bp, Artificial sequence
  Synthetic oligonucleotide sequence
agagcattaacctgcctaatcttca

SEQ ID NO: 1859 - DNA, 25 bp, Artificial sequence
  Synthetic oligonucleotide sequence
aacctgcctaatcttcatggtgaaa

SEQ ID NO: 1860 - DNA, 25 bp, Artificial sequence
  Synthetic oligonucleotide sequence
aattacaccttctctattctagtca

SEQ ID NO: 1861 - DNA, 25 bp, Artificial sequence
  Synthetic oligonucleotide sequence
gagttttttatatactgtagcctga

SEQ ID NO: 1862 - DNA, 25 bp, Artificial sequence
  Synthetic oligonucleotide sequence
gtgtttgactattttccaacttgta

SEQ ID NO: 1863 - DNA, 25 bp, Artificial sequence
  Synthetic oligonucleotide sequence
tgtgcatgctgctgtctctgttggg

SEQ ID NO: 1864 - DNA, 25 bp, Artificial sequence
  Synthetic oligonucleotide sequence
tattttagtagctgatgctggcaca

SEQ ID NO: 1865 - DNA, 25 bp, Artificial sequence
  Synthetic oligonucleotide sequence
tctctattctagtcatgctgtgcat

SEQ ID NO: 1866 - DNA, 25 bp, Artificial sequence
  Synthetic oligonucleotide sequence
tactgcctcagttattgaacttttt

SEQ ID NO: 1867 - DNA, 25 bp, Artificial sequence
  Synthetic oligonucleotide sequence
ataggagccttgtgttttgtcatct

SEQ ID NO: 1868 - DNA, 25 bp, Artificial sequence
  Synthetic oligonucleotide sequence
aagcctttggttcagagcagcctag

SEQ ID NO: 1869 - DNA, 25 bp, Artificial sequence
  Synthetic oligonucleotide sequence
aagttctcgggactatccagatcct

SEQ ID NO: 1870 - DNA, 25 bp, Artificial sequence
  Synthetic oligonucleotide sequence
cagcattttacccaagcgttttcta

SEQ ID NO: 1871 - DNA, 25 bp, Artificial sequence
  Synthetic oligonucleotide sequence
ctgcaaacattctgagctctctatc

SEQ ID NO: 1872 - DNA, 25 bp, Artificial sequence
  Synthetic oligonucleotide sequence
gaaggctgcttacccattcatagga

SEQ ID NO: 1873 - DNA, 25 bp, Artificial sequence
  Synthetic oligonucleotide sequence
gaattattttggcatcggcttcctt

SEQ ID NO: 1874 - DNA, 25 bp, Artificial sequence
  Synthetic oligonucleotide sequence
gtcatactggcttctttgggtcctg

SEQ ID NO: 1875 - DNA, 25 bp, Artificial sequence
  Synthetic oligonucleotide sequence
gtcatctctggatctctatcaatca

SEQ ID NO: 1876 - DNA, 25 bp, Artificial sequence
  Synthetic oligonucleotide sequence
tagctggaaccaacgggctgatcct

SEQ ID NO: 1877 - DNA, 25 bp, Artificial sequence
  Synthetic oligonucleotide sequence
tatcagctctggtgggtttcatcct

SEQ ID NO: 1878 - DNA, 25 bp, Artificial sequence
  Synthetic oligonucleotide sequence
atcttctcaatctttctttaccggg

SEQ ID NO: 1879 - DNA, 25 bp, Artificial sequence
  Synthetic oligonucleotide sequence
atgcctcatcttagcagtgattttg

SEQ ID NO: 1880 - DNA, 25 bp, Artificial sequence
  Synthetic oligonucleotide sequence
atctctttcctcattttcctgatag

SEQ ID NO: 1881 - DNA, 25 bp, Artificial sequence
  Synthetic oligonucleotide sequence
aggcttatctttttgtctagtgcaa

SEQ ID NO: 1882 - DNA, 25 bp, Artificial sequence
  Synthetic oligonucleotide sequence
aaacctgactgagttttcctgtcta

SEQ ID NO: 1883 - DNA, 25 bp, Artificial sequence
  Synthetic oligonucleotide sequence
aagctcagtacactaatgcctcatc

SEQ ID NO: 1884 - DNA, 25 bp, Artificial sequence
  Synthetic oligonucleotide sequence
aatacgcttggcactgatgggcact

SEQ ID NO: 1885 - DNA, 25 bp, Artificial sequence
  Synthetic oligonucleotide sequence
cagaccccggatgctatttattcaa

SEQ ID NO: 1886 - DNA, 25 bp, Artificial sequence
  Synthetic oligonucleotide sequence
gatgaggatggccttcctgtttcac

SEQ ID NO: 1887 - DNA, 25 bp, Artificial sequence
  Synthetic oligonucleotide sequence
gtttgaatgagtccttcgtgggcca

SEQ ID NO: 1888 - DNA, 25 bp, Artificial sequence
  Synthetic oligonucleotide sequence
tttacctaaatacttccagctcctt

SEQ ID NO: 1889 - DNA, 25 bp, Artificial sequence
  Synthetic oligonucleotide sequence
acgccaatgggtcaaactaactctg

SEQ ID NO: 1890 - DNA, 25 bp, Artificial sequence
  Synthetic oligonucleotide sequence
agaagtcctctctgagactcaaggg

SEQ ID NO: 1891 - DNA, 25 bp, Artificial sequence
  Synthetic oligonucleotide sequence
aaagcccatgagctgcttctttgtt

SEQ ID NO: 1892 - DNA, 25 bp, Artificial sequence
  Synthetic oligonucleotide sequence
aaaaatctctcatcctattctgctt

SEQ ID NO: 1893 - DNA, 25 bp, Artificial sequence
  Synthetic oligonucleotide sequence
aagccttcctaaaagcacacttgcc

SEQ ID NO: 1894 - DNA, 25 bp, Artificial sequence
  Synthetic oligonucleotide sequence
aagggctaaggcaaggtcttccaga

SEQ ID NO: 1895 - DNA, 25 bp, Artificial sequence
  Synthetic oligonucleotide sequence
caagaaatgacagcctccaagcctt

SEQ ID NO: 1896 - DNA, 25 bp, Artificial sequence
  Synthetic oligonucleotide sequence
gaagcttcttcccacctagaaagaa

SEQ ID NO: 1897 - DNA, 25 bp, Artificial sequence
  Synthetic oligonucleotide sequence
ggtgacaacgctggctgctgaaagc

SEQ ID NO: 1898 - DNA, 25 bp, Artificial sequence
  Synthetic oligonucleotide sequence
tttccactgtcgtcagagccaacaa

SEQ ID NO: 1899 - DNA, 25 bp, Artificial sequence
  Synthetic oligonucleotide sequence
ttctttgttctctgtcacgggacaa

SEQ ID NO: 1900 - DNA, 25 bp, Artificial sequence
  Synthetic oligonucleotide sequence
atccagattatgagcccatccggaa

SEQ ID NO: 1901 - DNA, 25 bp, Artificial sequence
  Synthetic oligonucleotide sequence
aggtaaatgagacagcccttcgctc

SEQ ID NO: 1902 - DNA, 25 bp, Artificial sequence
  Synthetic oligonucleotide sequence
agagccgtctgacagttcctgagga

SEQ ID NO: 1903 - DNA, 25 bp, Artificial sequence
  Synthetic oligonucleotide sequence
cagtggccacaatcatcgtagtcga

SEQ ID NO: 1904 - DNA, 25 bp, Artificial sequence
  Synthetic oligonucleotide sequence
cctttggcaaccgtctgtgggaatg

SEQ ID NO: 1905 - DNA, 25 bp, Artificial sequence
  Synthetic oligonucleotide sequence
gctaggctccttgtcagctgagaga

SEQ ID NO: 1906 - DNA, 25 bp, Artificial sequence
  Synthetic oligonucleotide sequence
gaagacccattatctctacctgaaa

SEQ ID NO: 1907 - DNA, 25 bp, Artificial sequence
  Synthetic oligonucleotide sequence
gacctgtacgctggcctgaatcaga

SEQ ID NO: 1908 - DNA, 25 bp, Artificial sequence
  Synthetic oligonucleotide sequence
gtaggcccctggatgttcgtttgca

SEQ ID NO: 1909 - DNA, 25 bp, Artificial sequence
  Synthetic oligonucleotide sequence
gttcgtttgcatctccatgaatgtg

SEQ ID NO: 1910 - DNA, 25 bp, Artificial sequence
  Synthetic oligonucleotide sequence
gggcttactgctgctggtgtattac

SEQ ID NO: 1911 - DNA, 25 bp, Artificial sequence
  Synthetic oligonucleotide sequence
atagatctctttgggtctgatgacg

SEQ ID NO: 1912 - DNA, 25 bp, Artificial sequence
  Synthetic oligonucleotide sequence
atgtgcagtccatggatgtggccgc

SEQ ID NO: 1913 - DNA, 25 bp, Artificial sequence
  Synthetic oligonucleotide sequence
agaaggccagtctgccaggagtgaa

SEQ ID NO: 1914 - DNA, 25 bp, Artificial sequence
  Synthetic oligonucleotide sequence
agaacgccttgcacagtatgagtca

SEQ ID NO: 1915 - DNA, 25 bp, Artificial sequence
  Synthetic oligonucleotide sequence
aaagctttgggcaagtatggtcctg

SEQ ID NO: 1916 - DNA, 25 bp, Artificial sequence
  Synthetic oligonucleotide sequence
aagaaacctgcacttgttgccaagt

SEQ ID NO: 1917 - DNA, 25 bp, Artificial sequence
  Synthetic oligonucleotide sequence
gcggatcactgcttttgaggactat

SEQ ID NO: 1918 - DNA, 25 bp, Artificial sequence
  Synthetic oligonucleotide sequence
ggctcctctaaactagttccagtgg

SEQ ID NO: 1919 - DNA, 25 bp, Artificial sequence
  Synthetic oligonucleotide sequence
ggtcctgcggatgtggaagacacca

SEQ ID NO: 1920 - DNA, 25 bp, Artificial sequence
  Synthetic oligonucleotide sequence
tggatgtggccgctttcaacaagat

SEQ ID NO: 1921 - DNA, 25 bp, Artificial sequence
  Synthetic oligonucleotide sequence
tgccaagtcttccatcttactagat

SEQ ID NO: 1922 - DNA, 25 bp, Artificial sequence
  Synthetic oligonucleotide sequence
atcactgctccaaatatctccaaag

SEQ ID NO: 1923 - DNA, 25 bp, Artificial sequence
  Synthetic oligonucleotide sequence
agtctgtttatatcaacgcgcaaaa

SEQ ID NO: 1924 - DNA, 25 bp, Artificial sequence
  Synthetic oligonucleotide sequence
agaagacgtttccacaacatctctc

SEQ ID NO: 1925 - DNA, 25 bp, Artificial sequence
  Synthetic oligonucleotide sequence
aatgatgtttctttgctatacttaa

SEQ ID NO: 1926 - DNA, 25 bp, Artificial sequence
  Synthetic oligonucleotide sequence
ccagtgattctgctgtactgcccag

SEQ ID NO: 1927 - DNA, 25 bp, Artificial sequence
  Synthetic oligonucleotide sequence
gaaatgtattttccctgtgattgat

SEQ ID NO: 1928 - DNA, 25 bp, Artificial sequence
  Synthetic oligonucleotide sequence
gatactgtataactcgcataacctt

SEQ ID NO: 1929 - DNA, 25 bp, Artificial sequence
  Synthetic oligonucleotide sequence
gtaattctgagtcactaggcaccct

SEQ ID NO: 1930 - DNA, 25 bp, Artificial sequence
  Synthetic oligonucleotide sequence
ggcaccctattatggttttactgca

SEQ ID NO: 1931 - DNA, 25 bp, Artificial sequence
  Synthetic oligonucleotide sequence
tgcccagccataaagatctccagaa

SEQ ID NO: 1932 - DNA, 25 bp, Artificial sequence
  Synthetic oligonucleotide sequence
tctctctctacttcattctcatata

SEQ ID NO: 1933 - DNA, 25 bp, Artificial sequence
  Synthetic oligonucleotide sequence
atcttcatttcctcttagctgtcag

SEQ ID NO: 1934 - DNA, 25 bp, Artificial sequence
  Synthetic oligonucleotide sequence
agacagagtgtgcattccttcttgc

SEQ ID NO: 1935 - DNA, 25 bp, Artificial sequence
  Synthetic oligonucleotide sequence
catcggaccaacttgtagctgacta

SEQ ID NO: 1936 - DNA, 25 bp, Artificial sequence
  Synthetic oligonucleotide sequence
aatgtgcccaggctgaactgctgga

SEQ ID NO: 1937 - DNA, 25 bp, Artificial sequence
  Synthetic oligonucleotide sequence
cgataagtctcgcttgttcttgcac

SEQ ID NO: 1938 - DNA, 25 bp, Artificial sequence
  Synthetic oligonucleotide sequence
gaggttgtccttaatcagccatcgg

SEQ ID NO: 1939 - DNA, 25 bp, Artificial sequence
  Synthetic oligonucleotide sequence
gagggtgattcgcatcttcatttcc

SEQ ID NO: 1940 - DNA, 25 bp, Artificial sequence
  Synthetic oligonucleotide sequence
gtcacatccatgagcccagtcaaga

SEQ ID NO: 1941 - DNA, 25 bp, Artificial sequence
  Synthetic oligonucleotide sequence
gtcattccattataccagctgaggt

SEQ ID NO: 1942 - DNA, 25 bp, Artificial sequence
  Synthetic oligonucleotide sequence
tatggcttggccttgagacttgctt

SEQ ID NO: 1943 - DNA, 25 bp, Artificial sequence
  Synthetic oligonucleotide sequence
ttcttgcccgttacacgataagtct

SEQ ID NO: 1944 - DNA, 25 bp, Artificial sequence
  Synthetic oligonucleotide sequence
agacttagacacaatgggccaccac

SEQ ID NO: 1945 - DNA, 25 bp, Artificial sequence
  Synthetic oligonucleotide sequence
acaaggcactctgtttgtctgttgc

SEQ ID NO: 1946 - DNA, 25 bp, Artificial sequence
  Synthetic oligonucleotide sequence
aatgggatgtctcttcagcttatga

SEQ ID NO: 1947 - DNA, 25 bp, Artificial sequence
  Synthetic oligonucleotide sequence
ctcacaggcctgtttttccaaaagt

SEQ ID NO: 1948 - DNA, 25 bp, Artificial sequence
  Synthetic oligonucleotide sequence
gcagctttgatgagcttcctcacag

SEQ ID NO: 1949 - DNA, 25 bp, Artificial sequence
  Synthetic oligonucleotide sequence
gaggaagcctgcctatgatctttta

SEQ ID NO: 1950 - DNA, 25 bp, Artificial sequence
  Synthetic oligonucleotide sequence
tgacacaatagcttcctggacaaca

SEQ ID NO: 1951 - DNA, 25 bp, Artificial sequence
  Synthetic oligonucleotide sequence
gggactcctggatgtctctagaaca

SEQ ID NO: 1952 - DNA, 25 bp, Artificial sequence
  Synthetic oligonucleotide sequence
tctgttgccttcattgtactgtttg

SEQ ID NO: 1953 - DNA, 25 bp, Artificial sequence
  Synthetic oligonucleotide sequence
tatcttgtggccatttaccagactt

SEQ ID NO: 1954 - DNA, 25 bp, Artificial sequence
  Synthetic oligonucleotide sequence
ttgtgattatctccccaactgaaat

SEQ ID NO: 1955 - DNA, 25 bp, Artificial sequence
  Synthetic oligonucleotide sequence
agtcagtttctttggttctctgcaa

SEQ ID NO: 1956 - DNA, 25 bp, Artificial sequence
  Synthetic oligonucleotide sequence
actttcttctatacttgcttcttta

SEQ ID NO: 1957 - DNA, 25 bp, Artificial sequence
  Synthetic oligonucleotide sequence
aatttgcctttcaagtttcctgtgc

SEQ ID NO: 1958 - DNA, 25 bp, Artificial sequence
  Synthetic oligonucleotide sequence
aattttgtttgcagtccttgagaat

SEQ ID NO: 1959 - DNA, 25 bp, Artificial sequence
  Synthetic oligonucleotide sequence
caagtttcctgtgctttgggtttga

SEQ ID NO: 1960 - DNA, 25 bp, Artificial sequence
  Synthetic oligonucleotide sequence
gacaggcctgaaactttcttctata

SEQ ID NO: 1961 - DNA, 25 bp, Artificial sequence
  Synthetic oligonucleotide sequence
ggtgatgcaaaccaatattctgctt

SEQ ID NO: 1962 - DNA, 25 bp, Artificial sequence
  Synthetic oligonucleotide sequence
ggatcagcttttggtatttcattgt

SEQ ID NO: 1963 - DNA, 25 bp, Artificial sequence
  Synthetic oligonucleotide sequence
taccagtgcttcaatgcagtcagtt

SEQ ID NO: 1964 - DNA, 25 bp, Artificial sequence
  Synthetic oligonucleotide sequence
tagttatgtcttttctctgtatgta

SEQ ID NO: 1965 - DNA, 25 bp, Artificial sequence
  Synthetic oligonucleotide sequence
ttctgctttggagcacatttcctaa

SEQ ID NO: 1966 - DNA, 25 bp, Artificial sequence
  Synthetic oligonucleotide sequence
atggatataccacaagctgctttat

SEQ ID NO: 1967 - DNA, 25 bp, Artificial sequence
  Synthetic oligonucleotide sequence
agcagtttggctattctcagtcctt

SEQ ID NO: 1968 - DNA, 25 bp, Artificial sequence
  Synthetic oligonucleotide sequence
aaaggtctcctggaatcatgatcag

SEQ ID NO: 1969 - DNA, 25 bp, Artificial sequence
  Synthetic oligonucleotide sequence
aatccatgaacacatcttctgtcag

SEQ ID NO: 1970 - DNA, 25 bp, Artificial sequence
  Synthetic oligonucleotide sequence
gagcgtatgctttcatttctattgg

SEQ ID NO: 1971 - DNA, 25 bp, Artificial sequence
  Synthetic oligonucleotide sequence
gatcttgtaccctgaaaacttccta

SEQ ID NO: 1972 - DNA, 25 bp, Artificial sequence
  Synthetic oligonucleotide sequence
gttgtctcctgttttggttattaca

SEQ ID NO: 1973 - DNA, 25 bp, Artificial sequence
  Synthetic oligonucleotide sequence
gtacatcctgttagacatcctacgt

SEQ ID NO: 1974 - DNA, 25 bp, Artificial sequence
  Synthetic oligonucleotide sequence
tttgccctcccaaacgaattgactt

SEQ ID NO: 1975 - DNA, 25 bp, Artificial sequence
  Synthetic oligonucleotide sequence
tgctttatccattcacctgttgaca

SEQ ID NO: 1976 - DNA, 25 bp, Artificial sequence
  Synthetic oligonucleotide sequence
ttgacagtcttttgggttgtctcct

SEQ ID NO: 1977 - DNA, 25 bp, Artificial sequence
  Synthetic oligonucleotide sequence
cagctaaatttgtgttttccggaat

SEQ ID NO: 1978 - DNA, 25 bp, Artificial sequence
  Synthetic oligonucleotide sequence
aacatgtgttgtctgctggtgactc

SEQ ID NO: 1979 - DNA, 25 bp, Artificial sequence
  Synthetic oligonucleotide sequence
aacggccttggaattctcctgtgaa

SEQ ID NO: 1980 - DNA, 25 bp, Artificial sequence
  Synthetic oligonucleotide sequence
aaccgctctgtaccctaaatgttat

SEQ ID NO: 1981 - DNA, 25 bp, Artificial sequence
  Synthetic oligonucleotide sequence
aaggcatactcgcatgttgctagat

SEQ ID NO: 1982 - DNA, 25 bp, Artificial sequence
  Synthetic oligonucleotide sequence
gttagataaccacgcgtctgagact

SEQ ID NO: 1983 - DNA, 25 bp, Artificial sequence
  Synthetic oligonucleotide sequence
ggtgactccatgttgctggattcta

SEQ ID NO: 1984 - DNA, 25 bp, Artificial sequence
  Synthetic oligonucleotide sequence
ggattctacatctgctcgtccagaa

SEQ ID NO: 1985 - DNA, 25 bp, Artificial sequence
  Synthetic oligonucleotide sequence
ggctaactctaggaaggcattcttt

SEQ ID NO: 1986 - DNA, 25 bp, Artificial sequence
  Synthetic oligonucleotide sequence
tactttctccctttttatactgctt

SEQ ID NO: 1987 - DNA, 25 bp, Artificial sequence
  Synthetic oligonucleotide sequence
ttccagagccttttgagtcaacact

SEQ ID NO: 1988 - DNA, 25 bp, Artificial sequence
  Synthetic oligonucleotide sequence
atttcctggtaatctcaattcctgc

SEQ ID NO: 1989 - DNA, 25 bp, Artificial sequence
  Synthetic oligonucleotide sequence
atacgatgccgtatgatctgggcca

SEQ ID NO: 1990 - DNA, 25 bp, Artificial sequence
  Synthetic oligonucleotide sequence
agacctttgctgtgcgtcctggagc

SEQ ID NO: 1991 - DNA, 25 bp, Artificial sequence
  Synthetic oligonucleotide sequence
agccatggtcatttgtgttacgtat

SEQ ID NO: 1992 - DNA, 25 bp, Artificial sequence
  Synthetic oligonucleotide sequence
aaactttcctgagcttgtctgagtc

SEQ ID NO: 1993 - DNA, 25 bp, Artificial sequence
  Synthetic oligonucleotide sequence
caaggaaccctttctgcaagtcagt

SEQ ID NO: 1994 - DNA, 25 bp, Artificial sequence
  Synthetic oligonucleotide sequence
ctgtgtgtactatctttgctgttgt

SEQ ID NO: 1995 - DNA, 25 bp, Artificial sequence
  Synthetic oligonucleotide sequence
gaggtccctgggagcagttgcacat

SEQ ID NO: 1996 - DNA, 25 bp, Artificial sequence
  Synthetic oligonucleotide sequence
gtctgagtcttgaatcgttaccacg

SEQ ID NO: 1997 - DNA, 25 bp, Artificial sequence
  Synthetic oligonucleotide sequence
ggagggtgacattgctcaagccatg

SEQ ID NO: 1998 - DNA, 25 bp, Artificial sequence
  Synthetic oligonucleotide sequence
tcagcattcctgtttcccttatatc

SEQ ID NO: 1999 - DNA, 25 bp, Artificial sequence
  Synthetic oligonucleotide sequence
gtaaaatcccatcctttcggttgtg

SEQ ID NO: 2000 - DNA, 25 bp, Artificial sequence
  Synthetic oligonucleotide sequence
aaaggtagggtttgccctcttcatg

SEQ ID NO: 2001 - DNA, 25 bp, Artificial sequence
  Synthetic oligonucleotide sequence
atggcttggattggcctagtagcta

SEQ ID NO: 2002 - DNA, 25 bp, Artificial sequence
  Synthetic oligonucleotide sequence
aatacagtagcttgcctgctgggat

SEQ ID NO: 2003 - DNA, 25 bp, Artificial sequence
  Synthetic oligonucleotide sequence
gaatgaatcatttacccagtggaca

SEQ ID NO: 2004 - DNA, 25 bp, Artificial sequence
  Synthetic oligonucleotide sequence
gtcccactcctcaatacgtgtaaaa

SEQ ID NO: 2005 - DNA, 25 bp, Artificial sequence
  Synthetic oligonucleotide sequence
ggaagtgacttttagagatgcccaa

SEQ ID NO: 2006 - DNA, 25 bp, Artificial sequence
  Synthetic oligonucleotide sequence
tcagtcctaggttagaccctgtcca

SEQ ID NO: 2007 - DNA, 25 bp, Artificial sequence
  Synthetic oligonucleotide sequence
tgacaccttggtcttttgtttgcaa

SEQ ID NO: 2008 - DNA, 25 bp, Artificial sequence
  Synthetic oligonucleotide sequence
tctggatgtatccttgtgggcacat

SEQ ID NO: 2009 - DNA, 25 bp, Artificial sequence
  Synthetic oligonucleotide sequence
ttcatgtctactccttccaaatagt

SEQ ID NO: 2010 - DNA, 25 bp, Artificial sequence
  Synthetic oligonucleotide sequence
atctgtggcggatgtttcttctctg

SEQ ID NO: 2011 - DNA, 25 bp, Artificial sequence
  Synthetic oligonucleotide sequence
aggagttctcctgagctcagccgag

SEQ ID NO: 2012 - DNA, 25 bp, Artificial sequence
  Synthetic oligonucleotide sequence
agcagttcttcctgaacggctttga

SEQ ID NO: 2013 - DNA, 25 bp, Artificial sequence
  Synthetic oligonucleotide sequence
agactgacagctgactcccaggagt

SEQ ID NO: 2014 - DNA, 25 bp, Artificial sequence
  Synthetic oligonucleotide sequence
acgtgcatgtgtcttccaggagcat

SEQ ID NO: 2015 - DNA, 25 bp, Artificial sequence
  Synthetic oligonucleotide sequence
aaacaagcgacatcagcacctggga

SEQ ID NO: 2016 - DNA, 25 bp, Artificial sequence
  Synthetic oligonucleotide sequence
aaggaagggctctgcctgagcagtt

SEQ ID NO: 2017 - DNA, 25 bp, Artificial sequence
  Synthetic oligonucleotide sequence
gaacttggtcgcatttggtctgaaa

SEQ ID NO: 2018 - DNA, 25 bp, Artificial sequence
  Synthetic oligonucleotide sequence
gaaggagttccctgatcggctacag

SEQ ID NO: 2019 - DNA, 25 bp, Artificial sequence
  Synthetic oligonucleotide sequence
gtgaactgcctgttgaacttggtcg

SEQ ID NO: 2020 - DNA, 25 bp, Artificial sequence
  Synthetic oligonucleotide sequence
ggagcattgcacgttgcctgtagaa

SEQ ID NO: 2021 - DNA, 25 bp, Artificial sequence
  Synthetic oligonucleotide sequence
atgtgaaacacctctttgctgcatt

SEQ ID NO: 2022 - DNA, 25 bp, Artificial sequence
  Synthetic oligonucleotide sequence
atgtgattctgaagcctggccaatg

SEQ ID NO: 2023 - DNA, 25 bp, Artificial sequence
  Synthetic oligonucleotide sequence
actgaggacggcttttcctggacaa

SEQ ID NO: 2024 - DNA, 25 bp, Artificial sequence
  Synthetic oligonucleotide sequence
aaaagtcttgtaggtcactgcgcca

SEQ ID NO: 2025 - DNA, 25 bp, Artificial sequence
  Synthetic oligonucleotide sequence
ctgcattctttttcttcgcttacaa

SEQ ID NO: 2026 - DNA, 25 bp, Artificial sequence
  Synthetic oligonucleotide sequence
gtctttaatcattggttcggctgct

SEQ ID NO: 2027 - DNA, 25 bp, Artificial sequence
  Synthetic oligonucleotide sequence
ggtctactttttaatggctttcata

SEQ ID NO: 2028 - DNA, 25 bp, Artificial sequence
  Synthetic oligonucleotide sequence
tggaaacggtttcacttgccctttg

SEQ ID NO: 2029 - DNA, 25 bp, Artificial sequence
  Synthetic oligonucleotide sequence
tgcgccatctcagccatagtagttg

SEQ ID NO: 2030 - DNA, 25 bp, Artificial sequence
  Synthetic oligonucleotide sequence
ttcggctgctttttgtactttgttt

SEQ ID NO: 2031 - DNA, 25 bp, Artificial sequence
  Synthetic oligonucleotide sequence
ttgcagtttgcttccatgtgattct

SEQ ID NO: 2032 - DNA, 25 bp, Artificial sequence
  Synthetic oligonucleotide sequence
atctacatccatctggcagttgtgc

SEQ ID NO: 2033 - DNA, 25 bp, Artificial sequence
  Synthetic oligonucleotide sequence
atgaggatgacctctgatctccatc

SEQ ID NO: 2034 - DNA, 25 bp, Artificial sequence
  Synthetic oligonucleotide sequence
agcattgtcattcctgtggcgtgcg

SEQ ID NO: 2035 - DNA, 25 bp, Artificial sequence
  Synthetic oligonucleotide sequence
acaaaggttatttctgaggctcagg

SEQ ID NO: 2036 - DNA, 25 bp, Artificial sequence
  Synthetic oligonucleotide sequence
ctcgtgactaagagcctggtcctta

SEQ ID NO: 2037 - DNA, 25 bp, Artificial sequence
  Synthetic oligonucleotide sequence
ccctcatttcactgatgaccgtggg

SEQ ID NO: 2038 - DNA, 25 bp, Artificial sequence
  Synthetic oligonucleotide sequence
gaagtcatttggatcctaggcccat

SEQ ID NO: 2039 - DNA, 25 bp, Artificial sequence
  Synthetic oligonucleotide sequence
tggcgtgcgcactcgtgactaagag

SEQ ID NO: 2040 - DNA, 25 bp, Artificial sequence
  Synthetic oligonucleotide sequence
ggcagcgacatgagttggatccgtt

SEQ ID NO: 2041 - DNA, 25 bp, Artificial sequence
  Synthetic oligonucleotide sequence
taaaagagcagacacggccccaaac

SEQ ID NO: 2042 - DNA, 25 bp, Artificial sequence
  Synthetic oligonucleotide sequence
ttactgtcctgtttgctgtcacaca

SEQ ID NO: 2043 - DNA, 25 bp, Artificial sequence
  Synthetic oligonucleotide sequence
ataaccccacagcttgagtacttac

SEQ ID NO: 2044 - DNA, 25 bp, Artificial sequence
  Synthetic oligonucleotide sequence
atttgctgaataaccagtcctctcc

SEQ ID NO: 2045 - DNA, 25 bp, Artificial sequence
  Synthetic oligonucleotide sequence
aattccgttttcacagaagggctca

SEQ ID NO: 2046 - DNA, 25 bp, Artificial sequence
  Synthetic oligonucleotide sequence
agaatcttttctccatgcatgtaaa

SEQ ID NO: 2047 - DNA, 25 bp, Artificial sequence
  Synthetic oligonucleotide sequence
gagtacttactgcttggcgggtcac

SEQ ID NO: 2048 - DNA, 25 bp, Artificial sequence
  Synthetic oligonucleotide sequence
gtcctctccttttctgtgaaactaa

SEQ ID NO: 2049 - DNA, 25 bp, Artificial sequence
  Synthetic oligonucleotide sequence
gggctcaatttgttccttatcgtct

SEQ ID NO: 2050 - DNA, 25 bp, Artificial sequence
  Synthetic oligonucleotide sequence
tggtactcacccatggagatgctta

SEQ ID NO: 2051 - DNA, 25 bp, Artificial sequence
  Synthetic oligonucleotide sequence
tcccacccagttgagttatttgctt

SEQ ID NO: 2052 - DNA, 25 bp, Artificial sequence
  Synthetic oligonucleotide sequence
ttctcacttactttccctttaggag

SEQ ID NO: 2053 - DNA, 25 bp, Artificial sequence
  Synthetic oligonucleotide sequence
ttatcgtctccccattgaagtgtcg

SEQ ID NO: 2054 - DNA, 25 bp, Artificial sequence
  Synthetic oligonucleotide sequence
agacgatttccagtatctcagcaca

SEQ ID NO: 2055 - DNA, 25 bp, Artificial sequence
  Synthetic oligonucleotide sequence
cagtgtattcctggcctttatacgc

SEQ ID NO: 2056 - DNA, 25 bp, Artificial sequence
  Synthetic oligonucleotide sequence
aagtcagacacgcttcactagcagt

SEQ ID NO: 2057 - DNA, 25 bp, Artificial sequence
  Synthetic oligonucleotide sequence
catgcgactgggaacatcttgttgc

SEQ ID NO: 2058 - DNA, 25 bp, Artificial sequence
  Synthetic oligonucleotide sequence
cggtggctgccatctgtacagaaga

SEQ ID NO: 2059 - DNA, 25 bp, Artificial sequence
  Synthetic oligonucleotide sequence
gctcgagccacatgaaattgccaat

SEQ ID NO: 2060 - DNA, 25 bp, Artificial sequence
  Synthetic oligonucleotide sequence
gacaatttgtctcaatacccacacg

SEQ ID NO: 2061 - DNA, 25 bp, Artificial sequence
  Synthetic oligonucleotide sequence
gtttatctctcggacatctgtttat

SEQ ID NO: 2062 - DNA, 25 bp, Artificial sequence
  Synthetic oligonucleotide sequence
ggatgtttttctcaagcaggccctg

SEQ ID NO: 2063 - DNA, 25 bp, Artificial sequence
  Synthetic oligonucleotide sequence
tggcagttttgtgtggtccaaccta

SEQ ID NO: 2064 - DNA, 25 bp, Artificial sequence
  Synthetic oligonucleotide sequence
ttgggcctcttctttctcaaataat

SEQ ID NO: 2065 - DNA, 25 bp, Artificial sequence
  Synthetic oligonucleotide sequence
atccagggtggagtctatgcagaaa

SEQ ID NO: 2066 - DNA, 25 bp, Artificial sequence
  Synthetic oligonucleotide sequence
cagaaaagggcctcacctgccaggg

SEQ ID NO: 2067 - DNA, 25 bp, Artificial sequence
  Synthetic oligonucleotide sequence
aaggagccttcttgaggtcactgca

SEQ ID NO: 2068 - DNA, 25 bp, Artificial sequence
  Synthetic oligonucleotide sequence
gaaatgacccataatccagcaacgc

SEQ ID NO: 2069 - DNA, 25 bp, Artificial sequence
  Synthetic oligonucleotide sequence
gacatgagcgtttgtgtttgcttta

SEQ ID NO: 2070 - DNA, 25 bp, Artificial sequence
  Synthetic oligonucleotide sequence
gaggtcactgcatttgatcttcatg

SEQ ID NO: 2071 - DNA, 25 bp, Artificial sequence
  Synthetic oligonucleotide sequence
gtgggcagagacttggcatcattgt

SEQ ID NO: 2072 - DNA, 25 bp, Artificial sequence
  Synthetic oligonucleotide sequence
ggcatcattgtcatccagcaaataa

SEQ ID NO: 2073 - DNA, 25 bp, Artificial sequence
  Synthetic oligonucleotide sequence
tcagtctcccctagtccagaaaagg

SEQ ID NO: 2074 - DNA, 25 bp, Artificial sequence
  Synthetic oligonucleotide sequence
tgcgcattgctttccaaggagcctt

SEQ ID NO: 2075 - DNA, 25 bp, Artificial sequence
  Synthetic oligonucleotide sequence
tttgatcttcatggcggcacctgga

SEQ ID NO: 2076 - DNA, 25 bp, Artificial sequence
  Synthetic oligonucleotide sequence
gggatgcccaatcccgggacctaca

SEQ ID NO: 2077 - DNA, 25 bp, Artificial sequence
  Synthetic oligonucleotide sequence
aagaactttgtgtgcgaccccgagg

SEQ ID NO: 2078 - DNA, 25 bp, Artificial sequence
  Synthetic oligonucleotide sequence
gaggtacaggactttgaaacgttct

SEQ ID NO: 2079 - DNA, 25 bp, Artificial sequence
  Synthetic oligonucleotide sequence
ataagagcccgtgggtacttcaccg

SEQ ID NO: 2080 - DNA, 25 bp, Artificial sequence
  Synthetic oligonucleotide sequence
ctacaccgtaaggataagagcccgt

SEQ ID NO: 2081 - DNA, 25 bp, Artificial sequence
  Synthetic oligonucleotide sequence
ttgaaacgttctacgggatgcccaa

SEQ ID NO: 2082 - DNA, 25 bp, Artificial sequence
  Synthetic oligonucleotide sequence
ggtacttcaccggaatcgtgagcga

SEQ ID NO: 2083 - DNA, 25 bp, Artificial sequence
  Synthetic oligonucleotide sequence
tgatgcggaagatcttcccgcccat

SEQ ID NO: 2084 - DNA, 25 bp, Artificial sequence
  Synthetic oligonucleotide sequence
tgcagaaagtactcgctgatgcgga

SEQ ID NO: 2085 - DNA, 25 bp, Artificial sequence
  Synthetic oligonucleotide sequence
tgagtgacagcctgcagaacaagct

SEQ ID NO: 2086 - DNA, 25 bp, Artificial sequence
  Synthetic oligonucleotide sequence
tcctcgtcctgatctgcagaaagta

SEQ ID NO: 2087 - DNA, 25 bp, Artificial sequence
  Synthetic oligonucleotide sequence
ataatttacttccaccaatgagggt

SEQ ID NO: 2088 - DNA, 25 bp, Artificial sequence
  Synthetic oligonucleotide sequence
attgatactggagagcagcctcaga

SEQ ID NO: 2089 - DNA, 25 bp, Artificial sequence
  Synthetic oligonucleotide sequence
atgactttcctggaattggcgacaa

SEQ ID NO: 2090 - DNA, 25 bp, Artificial sequence
  Synthetic oligonucleotide sequence
aagccaatagctggttcaactgcag

SEQ ID NO: 2091 - DNA, 25 bp, Artificial sequence
  Synthetic oligonucleotide sequence
gaattttgactctccagaaagccaa

SEQ ID NO: 2092 - DNA, 25 bp, Artificial sequence
  Synthetic oligonucleotide sequence
gaatgcaatgtttcgtgtactgcta

SEQ ID NO: 2093 - DNA, 25 bp, Artificial sequence
  Synthetic oligonucleotide sequence
gaagatgttttcctgaagagccata

SEQ ID NO: 2094 - DNA, 25 bp, Artificial sequence
  Synthetic oligonucleotide sequence
gagatacgagtcttcaccagaggaa

SEQ ID NO: 2095 - DNA, 25 bp, Artificial sequence
  Synthetic oligonucleotide sequence
gagctgctactagtattatcctaat

SEQ ID NO: 2096 - DNA, 25 bp, Artificial sequence
  Synthetic oligonucleotide sequence
gatttacggattcatatgggccaat

SEQ ID NO: 2097 - DNA, 25 bp, Artificial sequence
  Synthetic oligonucleotide sequence
tggatttttctatttctttcacgga

SEQ ID NO: 2098 - DNA, 25 bp, Artificial sequence
  Synthetic oligonucleotide sequence
acctagacgacctctcgggattgac

SEQ ID NO: 2099 - DNA, 25 bp, Artificial sequence
  Synthetic oligonucleotide sequence
cgattccgttatgcggtccaagcaa

SEQ ID NO: 2100 - DNA, 25 bp, Artificial sequence
  Synthetic oligonucleotide sequence
tgaacgggaccagccaaacgacggg

SEQ ID NO: 2101 - DNA, 25 bp, Artificial sequence
  Synthetic oligonucleotide sequence
agaacttctcatgcttcatctacat

SEQ ID NO: 2102 - DNA, 25 bp, Artificial sequence
  Synthetic oligonucleotide sequence
gaccgtgatggtcaacaccagccaa

SEQ ID NO: 2103 - DNA, 25 bp, Artificial sequence
  Synthetic oligonucleotide sequence
gacgacgtccagtatttcctgtata

SEQ ID NO: 2104 - DNA, 25 bp, Artificial sequence
  Synthetic oligonucleotide sequence
gggatccagttcttcgattccgtta

SEQ ID NO: 2105 - DNA, 25 bp, Artificial sequence
  Synthetic oligonucleotide sequence
ggaatgtccccgttacatgagcgac

SEQ ID NO: 2106 - DNA, 25 bp, Artificial sequence
  Synthetic oligonucleotide sequence
tctacatcgtgcacttcatgatctg

SEQ ID NO: 2107 - DNA, 25 bp, Artificial sequence
  Synthetic oligonucleotide sequence
tttcggagaagctcgtctacaccaa

SEQ ID NO: 2108 - DNA, 25 bp, Artificial sequence
  Synthetic oligonucleotide sequence
ttgacctcttacaattacttcgtgg

SEQ ID NO: 2109 - DNA, 25 bp, Artificial sequence
  Synthetic oligonucleotide sequence
cgggcgactcgcagaatcaatacat

SEQ ID NO: 2110 - DNA, 25 bp, Artificial sequence
  Synthetic oligonucleotide sequence
acagagccccggtcagcgggtgaaa

SEQ ID NO: 2111 - DNA, 25 bp, Artificial sequence
  Synthetic oligonucleotide sequence
aactgaacgataaccatccgaccga

SEQ ID NO: 2112 - DNA, 25 bp, Artificial sequence
  Synthetic oligonucleotide sequence
aatcaatacattttcccgagtctgg

SEQ ID NO: 2113 - DNA, 25 bp, Artificial sequence
  Synthetic oligonucleotide sequence
tcggctgcctggtgaagaggttcct

SEQ ID NO: 2114 - DNA, 25 bp, Artificial sequence
  Synthetic oligonucleotide sequence
gcgtttctgcagctatttttctact

SEQ ID NO: 2115 - DNA, 25 bp, Artificial sequence
  Synthetic oligonucleotide sequence
ggtcccgcgcatcaaagacaaactg

SEQ ID NO: 2116 - DNA, 25 bp, Artificial sequence
  Synthetic oligonucleotide sequence
gcgacttccagtacgagctggtcat

SEQ ID NO: 2117 - DNA, 25 bp, Artificial sequence
  Synthetic oligonucleotide sequence
gaagaggttcctccggagacacagt

SEQ ID NO: 2118 - DNA, 25 bp, Artificial sequence
  Synthetic oligonucleotide sequence
ggagacacagtctgttccagccggt

SEQ ID NO: 2119 - DNA, 25 bp, Artificial sequence
  Synthetic oligonucleotide sequence
tgaagtttggccaagaggcttcccg

SEQ ID NO: 2120 - DNA, 25 bp, Artificial sequence
  Synthetic oligonucleotide sequence
aggccacccttctagcagagttaaa

SEQ ID NO: 2121 - DNA, 25 bp, Artificial sequence
  Synthetic oligonucleotide sequence
agaacttgcggcttgactagcagca

SEQ ID NO: 2122 - DNA, 25 bp, Artificial sequence
  Synthetic oligonucleotide sequence
aagagtgatgccctggtgtctccag

SEQ ID NO: 2123 - DNA, 25 bp, Artificial sequence
  Synthetic oligonucleotide sequence
cagctgcccaatgccatgtgaagta

SEQ ID NO: 2124 - DNA, 25 bp, Artificial sequence
  Synthetic oligonucleotide sequence
gagagaatgtcaccacctgagcagc

SEQ ID NO: 2125 - DNA, 25 bp, Artificial sequence
  Synthetic oligonucleotide sequence
gagttccctgccctgagagaatgtc

SEQ ID NO: 2126 - DNA, 25 bp, Artificial sequence
  Synthetic oligonucleotide sequence
gtctagtcttgaagtccctcattta

SEQ ID NO: 2127 - DNA, 25 bp, Artificial sequence
  Synthetic oligonucleotide sequence
ggtgataggacatctggcttgccag

SEQ ID NO: 2128 - DNA, 25 bp, Artificial sequence
  Synthetic oligonucleotide sequence
ggcttgccagcgaggtctttttgac

SEQ ID NO: 2129 - DNA, 25 bp, Artificial sequence
  Synthetic oligonucleotide sequence
taatgtgatgtttcggccaagccca

SEQ ID NO: 2130 - DNA, 25 bp, Artificial sequence
  Synthetic oligonucleotide sequence
tatgtgtcagtcacgtagccagctg

SEQ ID NO: 2131 - DNA, 25 bp, Artificial sequence
  Synthetic oligonucleotide sequence
atcggcacccgctagaaatacatgg

SEQ ID NO: 2132 - DNA, 25 bp, Artificial sequence
  Synthetic oligonucleotide sequence
atcattgtctcctgtggctgggaca

SEQ ID NO: 2133 - DNA, 25 bp, Artificial sequence
  Synthetic oligonucleotide sequence
aggctacctgaacactgtcactgtc

SEQ ID NO: 2134 - DNA, 25 bp, Artificial sequence
  Synthetic oligonucleotide sequence
agactctgtttgctggctacacgga

SEQ ID NO: 2135 - DNA, 25 bp, Artificial sequence
  Synthetic oligonucleotide sequence
agaagttatcagtaccagcagcaag

SEQ ID NO: 2136 - DNA, 25 bp, Artificial sequence
  Synthetic oligonucleotide sequence
agctgaagaccaatcacatcggcca

SEQ ID NO: 2137 - DNA, 25 bp, Artificial sequence
  Synthetic oligonucleotide sequence
gatccctctgtgcttctggaggcaa

SEQ ID NO: 2138 - DNA, 25 bp, Artificial sequence
  Synthetic oligonucleotide sequence
ggccaggccatgctttgggatttaa

SEQ ID NO: 2139 - DNA, 25 bp, Artificial sequence
  Synthetic oligonucleotide sequence
gggacatcatcaacgccttgtgctt

SEQ ID NO: 2140 - DNA, 25 bp, Artificial sequence
  Synthetic oligonucleotide sequence
ggcaagcacctttacacactagatg

SEQ ID NO: 2141 - DNA, 25 bp, Artificial sequence
  Synthetic oligonucleotide sequence
tacactgtccaggatgagagccact

SEQ ID NO: 2142 - DNA, 25 bp, Artificial sequence
  Synthetic oligonucleotide sequence
aatcagatctttgcagctttgaggg

SEQ ID NO: 2143 - DNA, 25 bp, Artificial sequence
  Synthetic oligonucleotide sequence
aatttggttggcattttcttcatga

SEQ ID NO: 2144 - DNA, 25 bp, Artificial sequence
  Synthetic oligonucleotide sequence
cttttgtgttggctctaactctgaa

SEQ ID NO: 2145 - DNA, 25 bp, Artificial sequence
  Synthetic oligonucleotide sequence
cctcctcatctttaaaccacgtatt

SEQ ID NO: 2146 - DNA, 25 bp, Artificial sequence
  Synthetic oligonucleotide sequence
gagcatcattcttttgtctccatgg

SEQ ID NO: 2147 - DNA, 25 bp, Artificial sequence
  Synthetic oligonucleotide sequence
gtttcctcacttttatttgccttag

SEQ ID NO: 2148 - DNA, 25 bp, Artificial sequence
  Synthetic oligonucleotide sequence
gtctccatggttacttgtgtgatac

SEQ ID NO: 2149 - DNA, 25 bp, Artificial sequence
  Synthetic oligonucleotide sequence
gtggtcttgtcttaacttttgtgtt

SEQ ID NO: 2150 - DNA, 25 bp, Artificial sequence
  Synthetic oligonucleotide sequence
ggagtatctgttgcccattactata

SEQ ID NO: 2151 - DNA, 25 bp, Artificial sequence
  Synthetic oligonucleotide sequence
tactgttttttctaatctcccttgt

SEQ ID NO: 2152 - DNA, 25 bp, Artificial sequence
  Synthetic oligonucleotide sequence
tttaatctaagcattttcccctcct

SEQ ID NO: 2153 - DNA, 25 bp, Artificial sequence
  Synthetic oligonucleotide sequence
gggacacccgatataattcgccgct

SEQ ID NO: 2154 - DNA, 25 bp, Artificial sequence
  Synthetic oligonucleotide sequence
agatgatgaaaaccccagctactgt

SEQ ID NO: 2155 - DNA, 25 bp, Artificial sequence
  Synthetic oligonucleotide sequence
agctactgtctgagcagccggctga

SEQ ID NO: 2156 - DNA, 25 bp, Artificial sequence
  Synthetic oligonucleotide sequence
aacagcttcaaatcgtttctcacct

SEQ ID NO: 2157 - DNA, 25 bp, Artificial sequence
  Synthetic oligonucleotide sequence
agccctacagggagcagtcagatga

SEQ ID NO: 2158 - DNA, 25 bp, Artificial sequence
  Synthetic oligonucleotide sequence
acaacgctcatttaaaccttcacat

SEQ ID NO: 2159 - DNA, 25 bp, Artificial sequence
  Synthetic oligonucleotide sequence
gcaccaggctcactgtcacagagaa

SEQ ID NO: 2160 - DNA, 25 bp, Artificial sequence
  Synthetic oligonucleotide sequence
gactctgctgtgtatttctgtgcca

SEQ ID NO: 2161 - DNA, 25 bp, Artificial sequence
  Synthetic oligonucleotide sequence
gagacctcatctcacgggtgggaaa

SEQ ID NO: 2162 - DNA, 25 bp, Artificial sequence
  Synthetic oligonucleotide sequence
gtgaccctacccaaggtggctgtgt

SEQ ID NO: 2163 - DNA, 25 bp, Artificial sequence
  Synthetic oligonucleotide sequence
gtggctgtgtttgaaccttcggaag

SEQ ID NO: 2164 - DNA, 25 bp, Artificial sequence
  Synthetic oligonucleotide sequence
atcaagtccctttcagtgttctgaa

SEQ ID NO: 2165 - DNA, 25 bp, Artificial sequence
  Synthetic oligonucleotide sequence
atcacctttggaagccagcggcaat

SEQ ID NO: 2166 - DNA, 25 bp, Artificial sequence
  Synthetic oligonucleotide sequence
agaggatgtaacaccaccttgccat

SEQ ID NO: 2167 - DNA, 25 bp, Artificial sequence
  Synthetic oligonucleotide sequence
agtctctgtcattcatttctgtcga

SEQ ID NO: 2168 - DNA, 25 bp, Artificial sequence
  Synthetic oligonucleotide sequence
agcggcaatgccattctgctactat

SEQ ID NO: 2169 - DNA, 25 bp, Artificial sequence
  Synthetic oligonucleotide sequence
acttcccacagatttgttatcctca

SEQ ID NO: 2170 - DNA, 25 bp, Artificial sequence
  Synthetic oligonucleotide sequence
aagtttgccttgtatctcctagtgc

SEQ ID NO: 2171 - DNA, 25 bp, Artificial sequence
  Synthetic oligonucleotide sequence
aagactgccgtgtgcccgaggtatg

SEQ ID NO: 2172 - DNA, 25 bp, Artificial sequence
  Synthetic oligonucleotide sequence
gagactgtgatttggttcttccttc

SEQ ID NO: 2173 - DNA, 25 bp, Artificial sequence
  Synthetic oligonucleotide sequence
gagtaaccatttcctttgtggccaa

SEQ ID NO: 2174 - DNA, 25 bp, Artificial sequence
  Synthetic oligonucleotide sequence
tgtggccaatctgtgtatgctttta

SEQ ID NO: 2175 - DNA, 25 bp, Artificial sequence
  Synthetic oligonucleotide sequence
atatattaccccttcatgtcctaag

SEQ ID NO: 2176 - DNA, 25 bp, Artificial sequence
  Synthetic oligonucleotide sequence
gatttgtccctgatacctttggagt

SEQ ID NO: 2177 - DNA, 25 bp, Artificial sequence
  Synthetic oligonucleotide sequence
aatcttgtgttaacttgcctccatc

SEQ ID NO: 2178 - DNA, 25 bp, Artificial sequence
  Synthetic oligonucleotide sequence
catcctgttttgtttgctttctcat

SEQ ID NO: 2179 - DNA, 25 bp, Artificial sequence
  Synthetic oligonucleotide sequence
gcctccatctttttcttgggtgaag

SEQ ID NO: 2180 - DNA, 25 bp, Artificial sequence
  Synthetic oligonucleotide sequence
gctgttcacagcttttcttggtagg

SEQ ID NO: 2181 - DNA, 25 bp, Artificial sequence
  Synthetic oligonucleotide sequence
gaatggcccttttgtgtctatgatg

SEQ ID NO: 2182 - DNA, 25 bp, Artificial sequence
  Synthetic oligonucleotide sequence
gtgcatacggttctgttatatccca

SEQ ID NO: 2183 - DNA, 25 bp, Artificial sequence
  Synthetic oligonucleotide sequence
ggtgtaccatgtttgatttgtccct

SEQ ID NO: 2184 - DNA, 25 bp, Artificial sequence
  Synthetic oligonucleotide sequence
ggacagtaactcttagccttgccta

SEQ ID NO: 2185 - DNA, 25 bp, Artificial sequence
  Synthetic oligonucleotide sequence
taatcattccattctttgtccatcc

SEQ ID NO: 2186 - DNA, 25 bp, Artificial sequence
  Synthetic oligonucleotide sequence
gagccaagaaggtttctcccgtgtt

SEQ ID NO: 2187 - DNA, 25 bp, Artificial sequence
  Synthetic oligonucleotide sequence
aagagactggatcacactgcctgct

SEQ ID NO: 2188 - DNA, 25 bp, Artificial sequence
  Synthetic oligonucleotide sequence
aagtctttgcctttattccctgaat

SEQ ID NO: 2189 - DNA, 25 bp, Artificial sequence
  Synthetic oligonucleotide sequence
ctttggattgttttatgctgctgga

SEQ ID NO: 2190 - DNA, 25 bp, Artificial sequence
  Synthetic oligonucleotide sequence
ctcccgagcactttggtccagaata

SEQ ID NO: 2191 - DNA, 25 bp, Artificial sequence
  Synthetic oligonucleotide sequence
gactaatgcatacttttgacctgaa

SEQ ID NO: 2192 - DNA, 25 bp, Artificial sequence
  Synthetic oligonucleotide sequence
gtgttcgttggctgttttcttcctc

SEQ ID NO: 2193 - DNA, 25 bp, Artificial sequence
  Synthetic oligonucleotide sequence
gggcaccttggtttctgtttatcct

SEQ ID NO: 2194 - DNA, 25 bp, Artificial sequence
  Synthetic oligonucleotide sequence
ggaccaagactattgcttcttcatt

SEQ ID NO: 2195 - DNA, 25 bp, Artificial sequence
  Synthetic oligonucleotide sequence
tgggagacatgtgatgacgccgatc

SEQ ID NO: 2196 - DNA, 25 bp, Artificial sequence
  Synthetic oligonucleotide sequence
ttctgtttatcctttctgtgttcgt

SEQ ID NO: 2197 - DNA, 25 bp, Artificial sequence
  Synthetic oligonucleotide sequence
atatcatggaggacctggataccaa

SEQ ID NO: 2198 - DNA, 25 bp, Artificial sequence
  Synthetic oligonucleotide sequence
atcatcaatgtcttccaccagtact

SEQ ID NO: 2199 - DNA, 25 bp, Artificial sequence
  Synthetic oligonucleotide sequence
acggccacagccactaatctggagg

SEQ ID NO: 2200 - DNA, 25 bp, Artificial sequence
  Synthetic oligonucleotide sequence
caagcagctgagtttcgaggagttc

SEQ ID NO: 2201 - DNA, 25 bp, Artificial sequence
  Synthetic oligonucleotide sequence
gagctggcgaacttcctcaagagta

SEQ ID NO: 2202 - DNA, 25 bp, Artificial sequence
  Synthetic oligonucleotide sequence
gatgcacgagcatgaccaaggccac

SEQ ID NO: 2203 - DNA, 25 bp, Artificial sequence
  Synthetic oligonucleotide sequence
gaggagttcatcatcctggtggcca

SEQ ID NO: 2204 - DNA, 25 bp, Artificial sequence
  Synthetic oligonucleotide sequence
ggaactgtcccagatggagcgcgac

SEQ ID NO: 2205 - DNA, 25 bp, Artificial sequence
  Synthetic oligonucleotide sequence
ggagagtggccatggtcacagccat

SEQ ID NO: 2206 - DNA, 25 bp, Artificial sequence
  Synthetic oligonucleotide sequence
ggagcgcgacatagagaccatcatc

SEQ ID NO: 2207 - DNA, 25 bp, Artificial sequence
  Synthetic oligonucleotide sequence
tgacgcatgcctcccatgagaagat

SEQ ID NO: 2208 - DNA, 25 bp, Artificial sequence
  Synthetic oligonucleotide sequence
agaacagcgtcagccagatctcggt

SEQ ID NO: 2209 - DNA, 25 bp, Artificial sequence
  Synthetic oligonucleotide sequence
acggtcgctttgctgaatgtttcta

SEQ ID NO: 2210 - DNA, 25 bp, Artificial sequence
  Synthetic oligonucleotide sequence
gcagttctgcactacgggcatggac

SEQ ID NO: 2211 - DNA, 25 bp, Artificial sequence
  Synthetic oligonucleotide sequence
gagcttggaatcagccttgaaggac

SEQ ID NO: 2212 - DNA, 25 bp, Artificial sequence
  Synthetic oligonucleotide sequence
gagcgcttccagaacctcgacagga

SEQ ID NO: 2213 - DNA, 25 bp, Artificial sequence
  Synthetic oligonucleotide sequence
gggaaaggccaagtgctcgcagttc

SEQ ID NO: 2214 - DNA, 25 bp, Artificial sequence
  Synthetic oligonucleotide sequence
gtgggaagcttttcttacctgttga

SEQ ID NO: 2215 - DNA, 25 bp, Artificial sequence
  Synthetic oligonucleotide sequence
ggtctggactcgctgcacaagaaca

SEQ ID NO: 2216 - DNA, 25 bp, Artificial sequence
  Synthetic oligonucleotide sequence
ggacgtgcccaagcagaactcgcag

SEQ ID NO: 2217 - DNA, 25 bp, Artificial sequence
  Synthetic oligonucleotide sequence
tgaaggaacacgtgcctttttctta

SEQ ID NO: 2218 - DNA, 25 bp, Artificial sequence
  Synthetic oligonucleotide sequence
tgacctgccaggattatgttgccct

SEQ ID NO: 2219 - DNA, 25 bp, Artificial sequence
  Synthetic oligonucleotide sequence
agggctttaggctgttctttcccat

SEQ ID NO: 2220 - DNA, 25 bp, Artificial sequence
  Synthetic oligonucleotide sequence
aggaggaggcatccatcaacctcaa

SEQ ID NO: 2221 - DNA, 25 bp, Artificial sequence
  Synthetic oligonucleotide sequence
agtggaggtattctaaggctgcccc

SEQ ID NO: 2222 - DNA, 25 bp, Artificial sequence
  Synthetic oligonucleotide sequence
aaatacaccccaagtggtcacgctg

SEQ ID NO: 2223 - DNA, 25 bp, Artificial sequence
  Synthetic oligonucleotide sequence
tgaagcccaatatggtaaccccagg

SEQ ID NO: 2224 - DNA, 25 bp, Artificial sequence
  Synthetic oligonucleotide sequence
gattgccatggcaactgtcacggca

SEQ ID NO: 2225 - DNA, 25 bp, Artificial sequence
  Synthetic oligonucleotide sequence
gtctgtggtattgtctgtgtatgct

SEQ ID NO: 2226 - DNA, 25 bp, Artificial sequence
  Synthetic oligonucleotide sequence
ggaatatgtcaagcgagccctggcc

SEQ ID NO: 2227 - DNA, 25 bp, Artificial sequence
  Synthetic oligonucleotide sequence
tgggatcaccttcctatctggaggc

SEQ ID NO: 2228 - DNA, 25 bp, Artificial sequence
  Synthetic oligonucleotide sequence
ttgcctccctggtgacattggtctg

SEQ ID NO: 2229 - DNA, 25 bp, Artificial sequence
  Synthetic oligonucleotide sequence
ttcatctctaaccatgcctactaag

SEQ ID NO: 2230 - DNA, 25 bp, Artificial sequence
  Synthetic oligonucleotide sequence
atcatgacccgctgctggaagaaca

SEQ ID NO: 2231 - DNA, 25 bp, Artificial sequence
  Synthetic oligonucleotide sequence
atcaagtcggatgtctggtcctttg

SEQ ID NO: 2232 - DNA, 25 bp, Artificial sequence
  Synthetic oligonucleotide sequence
agagttggattccactcacagctgt

SEQ ID NO: 2233 - DNA, 25 bp, Artificial sequence
  Synthetic oligonucleotide sequence
aagttgacatttctatggcctggga

SEQ ID NO: 2234 - DNA, 25 bp, Artificial sequence
  Synthetic oligonucleotide sequence
cagagtgtgctggaggacttctaca

SEQ ID NO: 2235 - DNA, 25 bp, Artificial sequence
  Synthetic oligonucleotide sequence
gatacaggatgcctcgaccagagca

SEQ ID NO: 2236 - DNA, 25 bp, Artificial sequence
  Synthetic oligonucleotide sequence
gagccagtaccaacagcagccgtga

SEQ ID NO: 2237 - DNA, 25 bp, Artificial sequence
  Synthetic oligonucleotide sequence
gattgtcacctatggcaggatccct

SEQ ID NO: 2238 - DNA, 25 bp, Artificial sequence
  Synthetic oligonucleotide sequence
ggacaatctctttttgactctagca

SEQ ID NO: 2239 - DNA, 25 bp, Artificial sequence
  Synthetic oligonucleotide sequence
tgccccgaggagctttacaacatca

SEQ ID NO: 2240 - DNA, 25 bp, Artificial sequence
  Synthetic oligonucleotide sequence
tcctttggtgtcctgctgatggaga

SEQ ID NO: 2241 - DNA, 25 bp, Artificial sequence
  Synthetic oligonucleotide sequence
gagttcgaagtcaccctaatcacgt

SEQ ID NO: 2242 - DNA, 25 bp, Artificial sequence
  Synthetic oligonucleotide sequence
caccaggactctagccccagagtgg

SEQ ID NO: 2243 - DNA, 25 bp, Artificial sequence
  Synthetic oligonucleotide sequence
aaatggaactctccttttcgagcat

SEQ ID NO: 2244 - DNA, 25 bp, Artificial sequence
  Synthetic oligonucleotide sequence
cggcccggacacaaggaggaagctc

SEQ ID NO: 2245 - DNA, 25 bp, Artificial sequence
  Synthetic oligonucleotide sequence
gcgtctgaccccagcgaagggccag

SEQ ID NO: 2246 - DNA, 25 bp, Artificial sequence
  Synthetic oligonucleotide sequence
gaagggccagccttgcttggttcag

SEQ ID NO: 2247 - DNA, 25 bp, Artificial sequence
  Synthetic oligonucleotide sequence
gactgtggagggacaggcttcccct

SEQ ID NO: 2248 - DNA, 25 bp, Artificial sequence
  Synthetic oligonucleotide sequence
gttagcttccccaaaagaattgtgt

SEQ ID NO: 2249 - DNA, 25 bp, Artificial sequence
  Synthetic oligonucleotide sequence
gtcaccctaatcacgtaaatggaac

SEQ ID NO: 2250 - DNA, 25 bp, Artificial sequence
  Synthetic oligonucleotide sequence
gtgcttgcttgggagttcgaagtca

SEQ ID NO: 2251 - DNA, 25 bp, Artificial sequence
  Synthetic oligonucleotide sequence
tagccccagagtggctccagaaggt

SEQ ID NO: 2252 - DNA, 25 bp, Artificial sequence
  Synthetic oligonucleotide sequence
caggctaccttctccatttggtttt

SEQ ID NO: 2253 - DNA, 25 bp, Artificial sequence
  Synthetic oligonucleotide sequence
agatgtgtggcccaaaactgctcca

SEQ ID NO: 2254 - DNA, 25 bp, Artificial sequence
  Synthetic oligonucleotide sequence
agccttcatgaagctggacacgcca

SEQ ID NO: 2255 - DNA, 25 bp, Artificial sequence
  Synthetic oligonucleotide sequence
agaagctcctgttcagcacctcagt

SEQ ID NO: 2256 - DNA, 25 bp, Artificial sequence
  Synthetic oligonucleotide sequence
aatacagtgtattttccagcttcct

SEQ ID NO: 2257 - DNA, 25 bp, Artificial sequence
  Synthetic oligonucleotide sequence
caagtgacactactggcccaggcta

SEQ ID NO: 2258 - DNA, 25 bp, Artificial sequence
  Synthetic oligonucleotide sequence
ccgtgcttttgttttgctgctgtaa

SEQ ID NO: 2259 - DNA, 25 bp, Artificial sequence
  Synthetic oligonucleotide sequence
tgaaaacagcttaattcctcctgcc

SEQ ID NO: 2260 - DNA, 25 bp, Artificial sequence
  Synthetic oligonucleotide sequence
tgataactcggaccgtgttcctgtg

SEQ ID NO: 2261 - DNA, 25 bp, Artificial sequence
  Synthetic oligonucleotide sequence
ttccagaattccttcagccaagcta

SEQ ID NO: 2262 - DNA, 25 bp, Artificial sequence
  Synthetic oligonucleotide sequence
ttcggatcccctctctgaagagaaa

SEQ ID NO: 2263 - DNA, 25 bp, Artificial sequence
  Synthetic oligonucleotide sequence
atgattccagcagtggtcttgctct

SEQ ID NO: 2264 - DNA, 25 bp, Artificial sequence
  Synthetic oligonucleotide sequence
accctacccctgtaatgatgctatg

SEQ ID NO: 2265 - DNA, 25 bp, Artificial sequence
  Synthetic oligonucleotide sequence
ctgccattaatgctagctgacccta

SEQ ID NO: 2266 - DNA, 25 bp, Artificial sequence
  Synthetic oligonucleotide sequence
gtacccggacccaggagacttatga

SEQ ID NO: 2267 - DNA, 25 bp, Artificial sequence
  Synthetic oligonucleotide sequence
gagagcctcagctttgctatattct

SEQ ID NO: 2268 - DNA, 25 bp, Artificial sequence
  Synthetic oligonucleotide sequence
gatgccatcctgttcttgtatggta

SEQ ID NO: 2269 - DNA, 25 bp, Artificial sequence
  Synthetic oligonucleotide sequence
tgtttatattctagtctcaccccta

SEQ ID NO: 2270 - DNA, 25 bp, Artificial sequence
  Synthetic oligonucleotide sequence
tttcaaacagatgcccttggtcaca

SEQ ID NO: 2271 - DNA, 25 bp, Artificial sequence
  Synthetic oligonucleotide sequence
taacggacatcagtggttcctcttc

SEQ ID NO: 2272 - DNA, 25 bp, Artificial sequence
  Synthetic oligonucleotide sequence
ttggttgaacaagcagcggccctgg

SEQ ID NO: 2273 - DNA, 25 bp, Artificial sequence
  Synthetic oligonucleotide sequence
ttgctcttactccttttggttgaac

SEQ ID NO: 2274 - DNA, 25 bp, Artificial sequence
  Synthetic oligonucleotide sequence
agattctggtgtttggtctcttcac

SEQ ID NO: 2275 - DNA, 25 bp, Artificial sequence
  Synthetic oligonucleotide sequence
actggctccatatcatttggctttc

SEQ ID NO: 2276 - DNA, 25 bp, Artificial sequence
  Synthetic oligonucleotide sequence
ctgcgtctgcacttgtttgtgtaca

SEQ ID NO: 2277 - DNA, 25 bp, Artificial sequence
  Synthetic oligonucleotide sequence
ccatgcaagagctggcactttttta

SEQ ID NO: 2278 - DNA, 25 bp, Artificial sequence
  Synthetic oligonucleotide sequence
gaccctcctgtgtgcaatgccgtaa

SEQ ID NO: 2279 - DNA, 25 bp, Artificial sequence
  Synthetic oligonucleotide sequence
gtctcttcactcttgattcagatct

SEQ ID NO: 2280 - DNA, 25 bp, Artificial sequence
  Synthetic oligonucleotide sequence
gggagagtctctgatcttaacactt

SEQ ID NO: 2281 - DNA, 25 bp, Artificial sequence
  Synthetic oligonucleotide sequence
tgtttgtgtacagtgatcgctctca

SEQ ID NO: 2282 - DNA, 25 bp, Artificial sequence
  Synthetic oligonucleotide sequence
tgatttactgcttgcagctcagcgg

SEQ ID NO: 2283 - DNA, 25 bp, Artificial sequence
  Synthetic oligonucleotide sequence
tgatcgctctcactctgatttactg

SEQ ID NO: 2284 - DNA, 25 bp, Artificial sequence
  Synthetic oligonucleotide sequence
ttttcggtcttctgtttgaggttca

SEQ ID NO: 2285 - DNA, 25 bp, Artificial sequence
  Synthetic oligonucleotide sequence
atacgttaaatttcagcccaagcaa

SEQ ID NO: 2286 - DNA, 25 bp, Artificial sequence
  Synthetic oligonucleotide sequence
atctttcttacttgttccttatgcg

SEQ ID NO: 2287 - DNA, 25 bp, Artificial sequence
  Synthetic oligonucleotide sequence
atgcaagttttctctttaaccctga

SEQ ID NO: 2288 - DNA, 25 bp, Artificial sequence
  Synthetic oligonucleotide sequence
aggcttcctgatgcatttctaaatt

SEQ ID NO: 2289 - DNA, 25 bp, Artificial sequence
  Synthetic oligonucleotide sequence
acatatgctgtactaggcttcctga

SEQ ID NO: 2290 - DNA, 25 bp, Artificial sequence
  Synthetic oligonucleotide sequence
aaaaccgtgtctcatacatatgctg

SEQ ID NO: 2291 - DNA, 25 bp, Artificial sequence
  Synthetic oligonucleotide sequence
gaaccttttggtctgttatgatctt

SEQ ID NO: 2292 - DNA, 25 bp, Artificial sequence
  Synthetic oligonucleotide sequence
gtaactgtgacagcagccctggaat

SEQ ID NO: 2293 - DNA, 25 bp, Artificial sequence
  Synthetic oligonucleotide sequence
gtcagccagggcttcagatctcagg

SEQ ID NO: 2294 - DNA, 25 bp, Artificial sequence
  Synthetic oligonucleotide sequence
ggcacaagcactctgtaatacgtta

SEQ ID NO: 2295 - DNA, 25 bp, Artificial sequence
  Synthetic oligonucleotide sequence
ttaaccctgagccagtgactatgcc

SEQ ID NO: 2296 - DNA, 25 bp, Artificial sequence
  Synthetic oligonucleotide sequence
atagggtggtggaccttatggccca

SEQ ID NO: 2297 - DNA, 25 bp, Artificial sequence
  Synthetic oligonucleotide sequence
atattgagagtctcctgacctccac

SEQ ID NO: 2298 - DNA, 25 bp, Artificial sequence
  Synthetic oligonucleotide sequence
agaaaggccctcagctgctgggaat

SEQ ID NO: 2299 - DNA, 25 bp, Artificial sequence
  Synthetic oligonucleotide sequence
actttgtcaagctcatttcctggta

SEQ ID NO: 2300 - DNA, 25 bp, Artificial sequence
  Synthetic oligonucleotide sequence
gctgggaatgcttgtcccaacttga

SEQ ID NO: 2301 - DNA, 25 bp, Artificial sequence
  Synthetic oligonucleotide sequence
gagactagttctctcgtgacaccca

SEQ ID NO: 2302 - DNA, 25 bp, Artificial sequence
  Synthetic oligonucleotide sequence
ggcccacatggcctccaaggagtaa

SEQ ID NO: 2303 - DNA, 25 bp, Artificial sequence
  Synthetic oligonucleotide sequence
ggagccctaccttgtcatgtaccat

SEQ ID NO: 2304 - DNA, 25 bp, Artificial sequence
  Synthetic oligonucleotide sequence
ggaccaccaatcacccagcaagaga

SEQ ID NO: 2305 - DNA, 25 bp, Artificial sequence
  Synthetic oligonucleotide sequence
tgacctccacagtttccatctcaga

SEQ ID NO: 2306 - DNA, 25 bp, Artificial sequence
  Synthetic oligonucleotide sequence
ttgccctcaacgaccactttgtcaa

SEQ ID NO: 2307 - DNA, 25 bp, Artificial sequence
  Synthetic oligonucleotide sequence
atgcgcacatttactagcacctact

SEQ ID NO: 2308 - DNA, 25 bp, Artificial sequence
  Synthetic oligonucleotide sequence
atggacttccctgcattgtatgaga

SEQ ID NO: 2309 - DNA, 25 bp, Artificial sequence
  Synthetic oligonucleotide sequence
atgtgctgtgtgctctgtgtaccct

SEQ ID NO: 2310 - DNA, 25 bp, Artificial sequence
  Synthetic oligonucleotide sequence
agttgtctggcccaaagcatcagca

SEQ ID NO: 2311 - DNA, 25 bp, Artificial sequence
  Synthetic oligonucleotide sequence
gagttcgattcccatctgaaacgac

SEQ ID NO: 2312 - DNA, 25 bp, Artificial sequence
  Synthetic oligonucleotide sequence
gagacattttccgttgtcacaactt

SEQ ID NO: 2313 - DNA, 25 bp, Artificial sequence
  Synthetic oligonucleotide sequence
gagaggtcaccgatgctgctaaaca

SEQ ID NO: 2314 - DNA, 25 bp, Artificial sequence
  Synthetic oligonucleotide sequence
gtgtggccttagtgaccaatcagtc

SEQ ID NO: 2315 - DNA, 25 bp, Artificial sequence
  Synthetic oligonucleotide sequence
tgtgtaccctcagatcacgtgaact

SEQ ID NO: 2316 - DNA, 25 bp, Artificial sequence
  Synthetic oligonucleotide sequence
tactgagggcttaccatgtgctgtg

SEQ ID NO: 2317 - DNA, 25 bp, Artificial sequence
  Synthetic oligonucleotide sequence
ttcacccctcggaacatcgatgatg

What is claimed is:

1. A composition comprising a DNA polymerase, whole peripheral blood leukocyte cDNA, wherein the peripheral blood is from a subject with a clinical sign of endotoxemia, and wherein the leukocyte cDNA comprises lysosomal associated membrane protein-1 (LAMP-1) cDNA and matrix metalloproteinase-8 (MMP-8) cDNA; and at least one oligonucleotide primer that comprises a covalently or chemically attached label and that hybridizes to LAMP-1 cDNA.

2. The composition according to claim 1, wherein the DNA polymerase is a thermostable DNA polymerase.

3. The composition according to claim 2, wherein the DNA polymerase is Taq polymerase.

4. The composition according to claim 1, wherein the label comprises a fluorophore.

* * * * *